United States Patent 7,482,117 (GENETIC POLYMORPHISMS ASSOCIATED WITH MYOCARDIAL INFARCTION, METHODS OF DETECTION AND USES THEREOF) - sequence listing, part 7

SEQ ID NO: 17695 - DNA, 86131 bp, Homo sapiens
gggacaaggtttgggaaagtttgctatcagccccttgtaagattaagtcttcttaaatgcaaggttcctcaattctgtgcagtgtccacgtggacccacccacataccatgagctgtgggaatgggaagaggggtaaggggaactggtgcccacactgactgctgggccctaagtaatgaagccctaggtgtctaaccgaggagtgccctgtcttctgctagcatctgtgaaattgtgggaggttacctggttcgttctcaagtagagtaaatcttcagcccttcatagtccttgacaaagcgttgagaaattgactagtgagtgactcaaactatgcagtaaataatagtagagagcatggtgtactaacaaaacaaaaacccatttctaaactgagaagtttgtaatccatccagaaccattgttataatgagctcttttcgcttccaaatagatttgcaagaacttgtattgagtctatttttaaaaatatgcattatactctgaacactgaaaaggcagagttttctaagtattgattcctgtgtcattcaattgtgagagcatttgagtttcaaaaatgttttcaaatgctcctgtaattttccttgtggggtggtgggaggagtgaaagtttactttcactgttggtaaaatgtctaggaacagaaggtctgaattaatagcctagttcctgcaatagcaatgattataagggtaagtttgagaacataaaaggttcaggatcctaggctaagcatgatacgtatgttaaatgagtaaactgttttgaacagagttgagcacatagtaagtgcagcataaatatttcttattcttatcattaccttatctcattcaatgaaatacaaactcttgtgttcatctctcagagatgagaaaatcaaggcttaaagaggtcagtaatttgcccaaggacagtggttagagtatttttggctgcaagcaatagaaaatgcaatgaaacactaatgttaattgttttacgtagaaagaaattcagattggctgccttatcagctctcactatgatcaagtagcctggttcctttctgctgttttccttgtcatcttcagtggatcagctatcacactggacaagcttctcacctcatagtcacagggtggctgcaagagcccaacctttcctagaagttgcctctgcagatttccccgcatgtctcatcagtcatggttgggccacgtgtccacccctgaagtgatcccaggttccagagaggaaaccaatgttgagcacacaaatacatttcaagtgctgtcctacacaaaatcagggatctgcccacgaggaagaagaggcggtggagcttggaaggtatgcaaccatggctgagactgtaagagccacggtggaactccaggttctgaacctcaaaggttccactttccattgtgatgaaagcatctcaggactgcactgcccagcttggcagccacagcctcacatgaccactgagcacttgaaatgtagttaatatgctaagaaagcccatttaaatttttattttcaacttacttaaattcaaagagccacaggggtctagtggctcctgtattgacagcacagggccaccttgttagtggcatcatttataaccctgggcagcattgctataggaatagccatatcctgtaggtctataatgctgtagaaatggaatgtgtggtgcgaatgaaatttaaaatttaagtagccacggtgaaaaaaaaagagaaacaagtaaaattcatttcataatatgctttatctctatttccaaaatattatcatctcaacatgtaagaaatataagaagtattcatgagatattttacattcctttgttcatcataagtgtttgagatcccatgtgtgtctgacacagcacctgactttgaactcaccacatttcgagtgccccatagcccatgtggccatggtttagagatttcagaaagcattcatggaaaattctctttcctgatcctcattcactatcctgggaagtggccagataaggaagcaaggcccagaagggcccagccagtggctctcagactccagagtcatcgagtccctcactcgagggcaggttaactcacagayggctggcccccaccctctgcatttgccatccagcaggtctgggtgggtaccaggatgcggattcgtaacaggagaggctgatgctgccagtctgggtccacattttgagaagcattcctccaagggtcccacccacgctcataccccagtaagtagatggctcagaattgaaatccttgctttccatcttacatctcattctctttatatgcacaaccatgaagccaggttgctaagacagtctgaaaacaactaccaaagaacagaggtgctgctcatggttaccccagtgtgctgcagcccctgtcctccagacagtgacagcagagtggacctaattttgatactttgtaaacattggaccaatgtgacctatcctagtcccgtgcctttctctggctgacttttcttttatctcatctgattgtgggttcaatttatttaaaggaaaccatttaatgaaatcttaaggaagccctcacctttatatttggtttaacagttgagtttttggggtacagctgaggtctctatcattgcaatgtctagggtgtccctgaagttcaggtgggaatctgaagacactttcctgatccacgcaggcgacttcagacaatgtcctacacttagccacgggtaaatcatgcttttaatatgctcaatggcagaactggtcaaagccactctgagctgctgagagcacttcagattattttccacaccagcaggcgatagaagtggcattcagggactgctgtcattgctgctgagatccaagactcctcttggtgcactgtgatttgcagggaaagctgtgtctctctgacttgcaggccagaggttctgaagattgcttgaggttgcaagtacctccaagcttgagcagcagttttgaagtgtggagatgggaggtgagttattcacatctctaacaaaggagctgctgcttctggcttcaggaggggctgagaggcccctgattcactatctcatcactgggctggaagctccacagggatcagttaggcctgtgggccatgctttcagcacttggaggagaagatcccttagactcagcctttggctccatgccactcttgacaatgtacagggaagccacttggacctgatgctggagtttaatcaacagacaaggaagaggccccagtgtgtactgggcaaaagaacgggacgggtgtgctgaaaagcgtctcataaacagactttgttttcctgtgttttaactcagcgtgaaagtttctctaggtctcctctcctgggggagaaaggtagcggctggtttcctgttccattgcttctttagtatcctgagagagaacagccatgggcacccagctgcccmagcctcttcctgtcccggggccccgaggctgcccttcagcggtctccagcttcctgctcctgtaagcaggggcctctctttttggctttcctgacatttctcctgacctcttctgctagccctcctgaacgcacagtaatatctgtacattgcagttggtccccaggctgctgcctctctgtctctccatctaatgttgcatctgtgcactttagaagtacccgggagccttcaaaatatttggatgcctggacaccactccagataattcagtcagagtctctgaagacagggcccaggcatccctgtgtgaggccttcaggtaattccagcatacagcctgtattggaaagctctgtattgaggatgaggccctcatgctgcagagggggcctagagcacagggaagtaagttcctggaagcactagctgtttatcacatagggctaataaccaatggggacagtcgtgcatgcttctcttcttacatgctagcttactatgcttggaggcatacacatgtgtatggggagaggagggcagaatcggggagcattaggagaaaaacctaaagtaggcacaggaaagattccaggggctcacacatgaggcaggacaagaagaaatactttctcaggaaagggaaggggccgagtgttcaatgggcagagaggacagcagaagagaggagaccaggaagacaagatagcccccagcacttccacactaagccctggaaaggctatctgcagaggagccacctaagggtcttcccaagaccagggttaaagggaaaagcccctaaactcctcttccctcccaaatctgaggttgctcttgttcccttccaccaaaggatggcaccaagtagaatgacaaaggtgccatctccttcctctttctcagggaagggtctctctcttaaggacaaagatgtgaaaggtctctctcttagggacaaagaggaaaggacagaccaacctacagagtggaggagtgctagaccaaatcctcccaatacatctatttgagtagcagagactggagacagtggttgaggtcaactatggggctgcactggtgctgatcatgcccgtgctcccatcccacacctggataaacagcagtgggcagcttcccccaccccccagtcttagaaaggcctcctccagttgcaacaggactccctcctccccatcgctgtcccagccacccagcggaaagctgagaccccaccccccaggtggccaattttagacccactaaaggcctttctgggctgtactgggggctaaagggggccaccatcccacagagaaggggccaaagacagccaggatcctaaaagtcagagctactttaagaataactttcccaggccaatccccagttcaggaacgttcctgtgccctgtgccagctagagggactagggctggagccggcggctgctcctgggtgtccagtccaggagccagtgaactcactatctctggagtttagcagaagaagggtaattccaggccggaacccctttctttcccgacctctcgaccacagtcctccccaggcacattttagtggccagggatggagacccgcggataatgactgaaccaggtcacagggtgaaggttctgagatgtccggctcccgtagcttctgccagttcccgagggagctagcacaggcttggccttctttggtggcatctctgcctccacctgtccgtctccattccttgtgcccatagcacctcagctgctcggacacagaagttaaaaggtccggcatctgcacttgtccagagtgggttggggagcagagaaaggagtggtgagctgtggggaaaactggacatcctgacagacctgaaattcaccaagccgccagtggaagcctcaggttccgcctctataaaagggactcagccatgtgcaaggatgggtcgtcgcgaggattaaagggcagggtgaggggatgtcaagtgcaaggcaagtggtccaagcttccaggtggtccctgaccagttccgggcacatctttacccaaagggaggactccgggacccccagccccgccgccgcagaccccctgtagcaaagcagggaactggacctcaaagggctgctggggaagacgggatctgaatagaggtctgaaggaaagaagccaggcgggggaccccgggagggccggacggggctgggggtgctgttgacactggagccggactggagacctgggaacctggggcagagtcggcagcggggagggggcgaccgaggtgggaaaacggggcggggccggagacgactccagggctgggtgaggcgctgacccccaggagctggggtgccgaggggcgcgggccacagcggtgcgagccagtcgggcgcccgcgcggtggggcgcgcggcgcggggattggcgggcgctccccggtgcccgcagctcttcagcgtagccgggaagagccgcgcgtctgcgcgccagcccccgccctgggcccgccgcccgagctctctggcgcagcgctagctccgccgcgctcagctgccctgcgccggcacccctggtcatgagcgccccctcgacgctgccccccgggggcgaggaagggctggggacggcctggccctctgcagccaatgccagtagcgctccggcggaggcggaggaggcggtggcggggcccggggacgcgcgggcggcgggcatggtcgctatccagtgcatctacgcgctggtgtgcctggtggggctggtgggcaacgccctggtcatcttcgtgatccttcgctacgccaagatgaagacggctaccamcatctacctgctcaacctggccgtagccgacgagctcttcatgctgagcgtgcccttcgtggcctcgtcggccgccctgcgccactggcccttcggctccgtgctgtgccgcgcggtgctcagcgtcgacggcctcaacatgttcaccagcgtcttctgtctcaccgtgctcagcgtggaccgctacgtggccgtggtgcaccctctgcgcgcggcgacctaccggcggcccagcgtggccaagctcatcaacctgggcgtgtggctggcatccctgttggtcactctccccatcgccatcttcgcagacaccagaccggctcgcggcggccaggccgtggcctgcaacctgcagtggccacacccggcctggtcggcagtcttcgtggtctacactttcctgctgggcttcctgctgcccgtgctggccattggcctgtgctacctgctcatcgtgggcaagatgcgcgccgtggccctgcgcgmkggctggcagcagcgcaggcgctcggagaagaaaatcaccaggctggtgctgatggtcgtggtcgtctttgtgctctgctggatgcctttctacgtggtgcagctgctgaacctcktcgtgaccagccttgatgccaccgtcaaccacgtgtcccttatcctyagctatgccaacagctgcgccaacccyattctctatggcttcctctccgacaacttccgccgatycttccagcgggttctctgcctgcgctgctgcctcctggaaggtgctggaggtgctgaggaggagcccctggactactatgccactgctctcaagagcaaaggtggggcagggtgcatgtgccccccactcccctgccagcaggaagccctgcaaccagaacccggccgcaagcgcatccccctcaccaggaccaccaccttctgaggagcccttcccctacccaccctgcgtggccacctcccaaggggtgggcaccattcctacagccccgaagactgcatctcctgaatgctcacctaagctccaccacctgttccttccagcagcccatgtacctgccggagagtgtcagaactcttctgctgctctcctctcccctgcactctggctttcaaaaggatgcttccatatgggtaggactcctctggaaactgggctaggatattaatcattcctgaacctctggctgttcttcaagggctgggaagcaggaggtggtgagaaatgaatggtccctgtgtgtgactccttacagccactgcttgggagaggactcaagaaggtggagggaggtagcacccttcctctctgcagacgctctgccttgtggtgggagcacagcttgtacaggagagaggaggaaggaagatgcccccaggcacctgccctttatgtctcttcctgagctcttgttaagtgagacttatgttaacagcctggggcacttacttccctccccactcacccccggcctgggaataacatctgcttgctgtcacaggtgtctccctgagttgccctgagctgggagcagtcttcctgtgagtagaaaaggtttggagagacatgacatggggtttattgcaaggcataaaaccaggtcagtaataacaaagcagatgataaaaacttcatctagctcctatgatgtaattttttttccctgatcctttgatgtgggaacatgagaactcattaaggcagcaatttatactgtggtggtgagtgagagaggagccatgggcrggaaaagctgaccagagagcagcgagggatgggaaccagcccaggttttggatagaggaagcagcttcatcaccaccccctattttagaatgtcatctttcagtaaaacatcagccacattagatattaacatgtaagttgaacacaataaaaggccgtatctttgttgcctgatgtgttaaccaaaggataaattatctttcccaaagggaaagagcttaagaggagctctaattctgctttctgataaaagcaggggaggggacaaaggagaacttggaacacttatgttagcatctggtgtaacaacataggaacatgtatgaagtttgggggaccccacctggcttagcattcagagactacctctgggtttaaccggcctgattctggatgatcattctggtggtatggggaagatggtgtggggagggggagagacagccaaaggtcaacaccctatgcccttcagagtggtcagcctcacagaccactctgagagaatgggtagccatgtctgtactacatactggagacatgactgtggaatggaagtttcaaaactaagtcagagaaccctctgatcctgcaaacacacatgcacacacacagagacatcaaccatctctaatttgttggyacccaccagggataccttgggcatctgaagtcagtctccatgtctgtgggtctcgtgtaaccataactacttggagtttttwaaaactgcattatttctttgttcctcagtgtctgacaatgcctgccaggatgggcactgatgaatatggttgaacggaactccaaggaccacccaggttgatagtagtgaggtgaggggttcacagcactggcagtggtccccagggcttcttcccagcttgtacgtggggttgggggtcctttctttagtctctcagtgatcagactgggcaaactctctgakaagcaagacagggcayctaccaggagtcttggcaacactagtgtgtggctgcycagattagcatggaataagacacattctatttagaaatgtcagcctttttaacttagttgatgaaggttgaaggagaggcagcttcaggtgatggaaagaaaagtctctgagaggcaggacacctcagcctcagctaccccgtgagcagtgatttaacctctctaagcctcagtttcccacttggaatatgtgccaagggaggttcgagttttgagctcttcccagctgtaaactctgcattggcagagacaccgtggagacacgcgaatcaaatggtgggagggcaggagatagcacgcttctctgcttagtcctccttccatcaccactggaaaatgagcgtgaacactgcccttgaccctgcagtcataagtcatgcaggtggtggcggggtgggggtgtagggtgagcctacccgctgctctcttctttagcttcagggccttttcatttcccggcagcaacgaggtgcactgagcacttgtcggggctgtgtttggagcccatcaacagtgctaccagctttagttccatcaaccccaggcttttgtaacaactggttgcatgaaaccctcccttgtagtttgtgtacagaagactgcaatgaattgaagtcatgagacatacagccaggatcctgaaagccaccaacatatgtcacctgcctgggaggcttgcttcgatggtcatcttgttctgcctgctaagaccaggagtcacagctgttgacatcatggtgaataaaaacattttctgccacaggtagaaacagcctttgctcatccctccatctgtcagagatcttgctttttcttttacaattgtctttaatgtactgttccatggcaagccaggtgttccattttcccagatggtcagggaagatggtatttrgacatgacaggctgtcactcagcaggatacttgcccagtttgtcagctctgatctgtgagcaaagatgcatatgagtttcacactcatctgtgaagtattggcttcactttcattaaagtcatcatagctggcattccttagatgctagaggtggatgcaaaggatcaactaaatatagcacgttttggcrgcactgcctcagaaaccagacatgaatcctagcaaatgtgggcattgacactcttctctgagaggttggaggtagtgaattacccccatctcccacattctcattccataagtagatgacagcatagcctcagattccttaaggacaaatgttagaatcctagggctgtgttttctgagacagctccaccatggtgtacaccatcagccagcagcacaccctggaaactgtcttgctgactagcatgcatgggggtatacatgtggacagttcgctgagtgcttctctcgggtggtgcaacaggtttccagacaaaacgatgagtctacaaaggcagcttctgccttcatggagcttggaggttagtggcaaaagacaggcattaatcaaataagcacagaaatgagagtacagttctaaacctaaataagcactgtgcaggaaaggaatgtactttctaagagatgatgataaaagaagttgcccatgactcagagcaggctttccccaggaaagtggctggagatgacctcctctgaagcgtacctaggcattaactaggaaaggaaggggcggggcacaaggtgttcctgtaagctctaagcagagggaacagcatgtgcaaagagcttgcagtgggaggcactgaagggctcaatgtgaccaaaacacagaccacaggggcgtgtgaggcactggcaggcacatgagcaggagcctaatgccttctatgccacctcaaggatgagggctgtgtcctaagagccaggggtcagtggtggcaggctctaatgaggggcttgggtctgcctagtaagagaagcctatcaaaagctttggggtccttgtgaaattgaggcttaacatgcctctgcttttcagggaggggttggcaggatgatcatgtccttctttccaactttcatcaactttatatgaactgaaaggcagggacctcaatcctgtgaaggaagggactttagtgcctaacagtgggggcaccttctgaaatgggggagaacttatgtaaaaaaatgcctagaatgggagtattgactttctacaaagaaaaacatgtggcttcctattgtcaaaagacaccatgagcatccacctgccgtaacatagcacttgaaatgactggatttctggggctctgcctaaagagtggggctgccaaaggtcagcactcacccagtgtgaacgtgtcgtagatggggagaaagaacaaattgagaggcacacaaaccaggactgagttccggctctcccacttccagcccacagtggcccagggaaggctgcatgactgtgtggagagggcagagcaacagtatccacctgcaggtgcacagtgacacacaaaggccatgttcctggcccaggggaggaaggtttaccattcaaatggtgactacttcatgatatagaaggaggaagagggagttggtacacagttgggtgtcttttttttccatttttttttttaatcaggctttcattagtgttctgaagaggctgtaatttctttttaatctatttttaattggagtataatttacatatggtagagtgttctctttctagttgtacagttctatgaattttgacatgcaaatttttacattttacattttacaattttacattttacattggggcaactaactgttgccccaatcaagatcgggactgttttggtcaccatctacttccctcttagtggctgtgatttgtggccaaggaggaaggacacagacagcatggggaggacctgaggaggtacagaattggagatggtgctatccccaaatccatggaggccacctggttataccatttcccgagttcatccccccagactaggagacctcaaccaatttacataggaagctatagccctcttgaccttatggatctgaaaagaagtatcctggaatctagacaccacctggagaaactagagggttgagtatgtccctgggcaagctgctaattccataatgacttcgtgatcctttactccaagcactggagagagggtgtggattccactccaagctcccttccgccaaacagagcagagtgctcctcaagatccagccgcatcccaaaagcaccatttccgtttgtcacgggcctccaggcagcttgctgttgagtttgctcrtgtttatcatggccgtatcctgtgctgtggagagtcatagacaaattaaacagtgaaactgggacttgccccatgcccttttcagactttccattctcctggcactacccttgggtttctgcatgctacctttttggaggagggggaaaatacatgaagaaagactggagtcaaaccctggcaaaggctcgctgaaaatggggatttgggattatatgagcatttcagaacagatttattaaaagagggggacaatgaacaaggcgtaggatctccaaagagtctgtggaaggtgggatccatgttcccaaaggatttaaatcgaaacaaggcagkaggcagtgggaaaaggggaggaattagggagaatgtggaaaagcccctctcctctttgccaagtagaacaaagctttgctggacaacagcggggtaacttagcatttaggtacggcattagcaagaagtcagaaagaagatttgagatgggcacagaggtgctaacctctaaccaaaagcacagaggttatattgccaggcgttgaatatgcagaagataagtgggttttgtcttaggataatatcggtattaaaatggctattttaagagaagatttccttcaggcagagatccaaggaaatatctggcctgtggcccaggtggcataattgtcacagaccccagctttgactcttggtgtttctcattggatccctgaaaccctctgctctctgctccccctctccagtgggcgtaaccttgagttaacccatccccagggttcttttgtctttcacaatcacactttcaaaacaccctgaaaaggatttcgattctattagcatctgatgttaaaacaatatttagcttcccttgtgagaagaaatcagttgtttgcctacatctgaacctgctaaccaaaaaaaaaaaaaatgaggaagggaacactcaaaacaaaaagagatatcactgaacccagggcattcattctggaaaagaaagaaagaaagaactgggcattgtctgcattgttttatgaagaaatgcttctaaagctcaggagatgtattttgggtacccccactcagctataaccatgaagaaaatgtgttttcatgtattatttgcaacctcagttttccttgaatagatgatataataaggaatcgcattcaacagagaatagcaagtgactccagaaggtaggaggtgggggatcttctgtcccctggccccatccacaaccataatgtctctcaaaggaatgtcacctacaggaacttccctccgtacctcctgctggctctgttggggccagagctatgtttctctttctcctctgggccctgagaaatggagaagggcactctggagcatgttcttcctcctccgagcctccttgggagaacagcggagggagtctctgtcccctgtacttgactaagccttgtgagaagggaaaataagctgaagccttcgaagctggattttagagtgaccgagtgttggagctcacttctcacctggcacaaaaatcttcctgtttaagctatgatrtagatgcctgcaaatccaacattacagttcctctagcattgacaacattgctccaagcaactgcatcttcccttgatggaacagtatccactttgtgcaaccttgagtttgcccgtaagacactcatgattccaacacagcttttttctgtactcatttatgcatctaccagttcactggcacacaagtaaacagttattgggtatctaccatgggccagaaactgagcttatctaatcttcctggaaaccttgtgaggcggcactgcttgaacccgtcttacagcctttgaagggtcatgtggtgcccgtggccatgtgaccagcaggtktcaggctggggtcacacccaggtgtgtatgctgttcacaccacatatcagccctgcggggtgcttacagcggaaattgtgcaggttcctgcccaagagggacatgtaaatacatctagaagtagttgttatcttcccaaacaatgcagtacataaattgaatcccagtgcactctcatcaaaactccttgagtgcccccacttgcacccagaacatttttcaatgtcactctttcagtctttttttcagtgtctttgacctacagcccctacagtcatctcccactgcttgtatctctctttccacctcttcagctgccttgcagcccacctcaccttgttcactatgcccagtccgctccaccagggctcttcccagtacagggcctttgcaggtgtgatccttcccacctggactgcttcccctccagtttgcatttgacaaacccctccttccccttcaggtctggtgttaagtgtcagcttgtccaggaagctccctctagtcctccactctaaatcctgccttcctcgtgcgccttttcagagtgtgctgtgcttttcttcccctgcacttatcactgtttctaagttaagtacaatttgggggtgatcagttgttttgcatctttctcccctgccagagtctaacttatatggtagggacttgtcattgtgcctatcactatgaaaggcacagagtaaatgctcagtaaataattgctgaactaatctaagaaataggtgagaactggaaaaaaaaaataacaaagtcatttgacttaaaaaaatgcattctgtttactttaaaacagcaggctaggaaaaacaaacaaacaaacaaacaaacaaacttgaatgctggcttatccagaaataccaccttggctttcttgccccggacttttgtgctatgaaatttcaccagcaactggtccctgggagtctccctcagacctggatgtccaatgatgtgaacagaaagcagagatcacacaggttgacccatggctctggtttcacaaggtctatcctgattttaaatkctcagggatagtttttaaagctaactgatttgtttatgtggtcctggtatctttccctgagaggcactatggctatttagcgttttgagaatctcaagttcagatgagacctataaacagaactgctgatcccccaggcagcaggaagtgaggaggacagggaagctcagggccccgcacaactaatgtcctggggcccaagtgctgcatgaagggtttttgcctctaggttttgaaagtgtgttttggtcttccagtgttccttaagaaaatgcccctcttctggaataagaagaaatcctaacgcaatgaggccctacaagtcagtttgacagtgactgggagcagactcttttgacaaacagaaggctgggtaacagggggcgaactataaggtgtcactgtctcctctggtctcccagccccatttatctgcacctgtcctgcccccatttgtgtagctcttccttcacaaagacttagtctgctacttagggggagcatggctcagcttgttatctccatagggcactgtgcatggagcttccccagcacacacacacacacactaaagccattacttcttctgcgatggatgtcaaaatctccaacccggtcttcacaataatcagtcaaactaaaactcatgagttcagcattatccagacatataaagcatctgaatatttgcctggactctacttgcttttaatttcttctttaaaaaatctttccgagccctgcatattgcattcagccagccctaccaccttagaaaagtgagcccaagaaacgtgtgcattgaaaagatgatgttgttaatctccaaaagagatgagaatgatttcatactggatgagacgtttagaaatgaatatttgaatgagagccacaaactgagacccttcatgactacagtgaatttggatatctcgcagaggagataatgccaaaccatacaccggacacacagctgggattcgccagatgccccaggaagggtttatttaattcattccaacaaatgatcctataatgcatttatgcatttaaaagcacagagacacaagtcctcatatatgaagttgttatggttacagaaagaaaataaatatttgtgcacacagagatagcatgaaatcattctacagtgaaaataatagcctctggaaaaagctttgaaaatcagagatggtgccaycaccagacaacacaagtgctggggtacagggcagccctccatgcatctcatagcatttgcatggtttgtgagccccatttaatgacataaaatgagggcactgagggaggaaaagtgaacagacacacaacccgagagcacattgttatttgtttattttgtacaagtgatgtcataagcaaggattttgcctgtgttctagattatctccaataaataaataactatgtacaaatattttgagtttacaaaatagaagaggaaaacctttgtcttacaaaagttacatttctatgatacatttatttccatacactgaagcaggatttcattcctagcttagctgaaccaaagaccttgcagaccctgtgtggcagtgtctagagctgtgtacctagccttttctaccaaagagcaaagctacacaaagaaaattcctcagtttcttgaaaataagggcctgacttggcctgctacttataactgatctatatttcatgtattccagaaaattggaagcagtctggaatggttgtcctcaaattactgagcagacacaccccctgcagatcttgttaaatatagattctcatgaactggatggggtggagcctaggattctgcatttctaaccagctcccatgggcagggcagcttccaattcttgttcaggggccacattccaaaaggcctctctgaaatggtagaaattctctgaggacctgattaaggctaggccctaattgggcatcctccaggatccattcccaagctcccaattccacaagaccagtagagctggttttattttggtctaccagtgacaaggaacagtgacagtcaattgctaattggcatgaatcatgcagtttgaagctttcttgaactgtctcctgggaggtgtttgtctcttctctcaatctagagcaaccttctgaacattttcaacactgtcaaaaataagtaataataacaaaaaaggaaattgcataagaagattagcaacaattaccatttttcagtacaaatcaaaacagcaacaaaattcaggctcactgtttaaaagtaaagataaatacctctttgggtgtaatttctatgacagtccagcaacatcaatttaayaccttttacatctcaacctttgtttaaaattattttgctctgggaatctgaaatttcaggataaattagcaaatctggtgaaaaagcaaatggccatttttatttttagtgtttttgtttctgtttcatgtaggggttctgtctgagcagacagctaagagcaaaagaagtagggtcaggcacaggtagggtgactcaggtgagttggcccagttcctgggaggagaaaactaggaagaatggggaataagtggggcttgcttcataaatgtgagagggctaggaaaaaaaaattcaccaagatagtttacctgtcacatgacaagtgggagtttgtagagagagagagaccggagagctgtgcaaagtggatactggagacatacaggtaagaacaaaggaaacaaacaaaaacctaaatacttaaaaaaaataaatattttagtcatccctagcccacgaggtcaaggtctgcccagaaggctgccgaccaataacgctcaccctcctgcgcccggtagtgaggacctgggacaaatcgcagtctgtgtcttcgttacaaaattgccatcattgcccagtggtccagtgacgtcacggaagaggccgaggctcattctcctccctctaatcaccccctcgccagttagccatggaatagaagaaaacagcttggggggtgcggggagggtcttctccagctgtmatgccagctaaggtgctttggtagcaaagctgggggtgaggaggcacaggctcctggacggagccaggctcctggacggaggccgctcagagtctctgcggcgtccgctcggtccgcacgtgctgcagcactacctccttggaaggggccgcgcacttgtactccatcttggccctggcggcgccctgcttcttgcgcaggtggcagaggagcgccaaaagcgccaccaccaggcacaggctcgcgatggagatgcctatgagcaagcccgaatgcacgagccccacggccggaggagtcaaggtggagccgrgcgtcgggctgggcggggrctcgccagagccgctgtcgccaccgtccaccttgccggagtcacagtcggtgccaatgtggcggrcaagggccgagtcgggcccgcagatgcactcgaaggtaccggggaggttgtggcacaccccggagcagaagccgccgttttcgcactcgtcgatgtccgtgcagatgaaaccgtcgtccaggatgtagccttcagggcactcacagctagcctgggtgttggggtcgcagtcggctggacaggcagtctggttgcaaaacatctggcacctgtgcggctcgtggggaatgggcgcgaagccctcggcgcagacgcagaggtagctagtttggttcaggggctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggscttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgscgtcgccgttcagtagcaaggaaatgacatcggcagccaccgaggagcgcactgtcattaggtggccccgcagtccgtcgcagatctgactggcattgaggaaggtcgyggggcccgggtagagcgcgaagcagtcgtgctcgacgcactggctgccacccggctgcggctctgcgggtgcggggaaccccaggcyggccagggccagcgcgccaaggaccaggaccccaagcatgttacccaggcgcgccgcgtgcaggcgccggggaaagcgcgggcactgcgacagggcsgtgccggagcagaggggcacaggacgccgatggcgacagcctctcctgtccgtcccagcccagacacttcttgccgctgcgcgcagcccctgcgaggcagcctctgacatgcggatcggccagggctcgagtttataagtgcccggccctccctccctggacgttcgggaaaaggaaggaagtgcctggtgggaagggctgatgccgcatactcggattgctgggttctctggccgcccttgcgcccgccctcgcgcatgggatcacctcgccgggatgagtaaaccctgccctggcgcagggaggttctcgggcggggccgacaggggcaggcgccagggaaggccagcacccctgtaacaagacgactgtccccgcccaccactcgggcccccacgcgtgcagccctctttcatctcttggtcctcctttctttcttttcatacatgttacagccacttccaaggaaagcctggattgcaagagctctgggaaccggagacttcagagaagagggctttgaatggggagtgggggaggtggtgcacaggacctgcaagacgctgggaggggtgatcggcaccaagggcactttgggaggacctgcctaggacgtggacttccccgaagacaggatcgcaaggagagacagctggatcctgtccgcggccaaggtgcctggctcaggaaaccagcggagcgcgcttggcctcacaggacagtgggtgtggctggggtgacggggcagggtggggaagactggcctaacaccagcgccctctgccccatggctggccagggacccgcgagtccctggacacgcactggccaacgccagaccccatctcatcgggtggggaagtcgcggggacactgtcagggcgccgaagtccggacccggctcagaggcggtggcaggtgaattgctgcggcgccgggtaggggcgggcgcgtgggagcgagtcagcctggccagtttcggcccagcttccgaaggatggtgcttcttgcaccccaacagagtggctggcaaccccccaggggagcgcgcaggatcccagctgatcccacccgggtcggctaaggaggtttccatttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctactgtcctcacaacgagcgccagggggcggcgctgtcgagctctaaacaaagccaaggaagttggagaagtttcgggctaaaaagggttaaggtgtaggagcacagagtcctccttctggggttggaagctccgttcccgggcagctcagcgtggattccgctgcgttcacctcttgcctccagggcccagtagatcctgggctttaaacaagaacagagagtatggcgtctgccacgtgcgacagacacgcaccggtggggtgggccgggctggactggactgacctgcagtgaccaaacgggtggggcgtggacactctgaaagtgaaaaaggcaagcacgactgtcccgccgcacactccccagcgccttggggcagagagcctccaaacgtcccgctgagttgagctcttcgctgggaaggccgccccagcacccaggaaacgaaggagctgctggacacgggggtctgaagctcccggaatgcacacagctgcgcctcccctgacgcggaccccctgggaagaggaagggaagagcggcagatagcacagtagggcttgtccggcgggagcagtcaagctgtggctgcctaggctgaatcagggggtcgtgactccggtgcacagcctgcctacgcgggacgcaaaagcagggctgcctgcggtgccgccatgggggtgagggtggagcttcagataagggcaggaacctcgttggggcactgctgaaaggtctcagaatgtggggacaattcccagagtgaatgagacaagagagggggacaggatcggttacagaatcagaaaccagtgcaaagtgaaaatgtggggtccattgttcaattacaaggattcaagactgtgatagcaaagtgttaaacaaggaatgaggccctgggggggtgatgagagggcccttctgaacctgccagccctaaaagccactgagggacattcaaggatcagatctcaccccacaccaggctggctgagttcttggatggattctagctgattcaccaacacaatgtttcactggacgtcctacacaggtccacttgcacccattgctgattcttgcaaagaaaaaaaaagtgtgagaacagccccaatagctgagtccactaagaactcagtgatgtctgtgaaacttggatcaaccctatatgaggaggtgcagatgttggatgtttctgtattagaaagaaactagagcaacaacagatagaagcagagcattgtcccatggggggtaccacagtgtctgggttgccctacacaaggatgggtggacatgacccacttggctttcccacctgtaagggctttacccmtgrccctcaggatacctttgccttgtggggcctgccctcagccgctttgtttttcctctccagccaataccttggaggctttgcatattttagactaccttctggtgactgaaggtcccctgtctgtgttcttgccccatccctatcttcctatctgtgccccctgcacaccagggtgggccactccttcctatccctttgcagataacacatccacttcccaatgcttggcccagttcctggcccagcrccctcactctggcccaccagcagacttgctttactcctgaaacagctcccttgaagaacacccatctggtcctaaatactgttgccaaaatcttgttttcagccatccttctagaagccttggtgccatttgcacttgtgacccttcaccattctcaaggctcctcctccaattacttttgagacacatgttttcctcccttcctctcctgtgagccttggggaggcccctgggatcctcttgtaccacccactagagtggccattctcaaggttttgctggtggtcttcatcatctctttacaacccaccttttggtgaacttacccattcccctggcagtgatagcagtgtccaaggagattggggagggagtattctagaagggacccttaccccatctttcccagtatcaatagttggtccactgaggttttaaaccatgcacttgcctttgactttctgctctccttcatccactgcctagtttttgtgtcttgtttcccctgatcactgctcctgccttctcaatttatgctgagacagttgggtccccagctcttttccttgctgcttatctctccagctctccaccgtggctgaggctactctgatcctcatactccctcagtgctgctcccacccgctgggagagcccatactctttcccctccgcactgaagatgctcgcgatagtgcctctactctgtggccacagatgagaaaatttgcactcaaggggctatgctggaatttggacccagagcctgcaccccttgcacctcacaaggcttcaaggaccagtgttctgctggtctccatgaatgaggaaacatcctggcaagggaggctcctgctcactgtcagagaagcaccttgtccgctcatctccaccctgtagttcatgtctctccctctgctagcaacattctcgtctgccaggctcttcacccactgaaatctttccattctttcaagtcccagttcaagcttccccatcagcaagttttctgaataacccaaccagaactgatctgtctgtgattcccatagacaggtcgttctctcagctctttagtactcaccactccctccctgccctgtacctaatcatgcatataccacactttttgctgcacttakactccagattcccacacatttttgtatccccttacacctaacagcacgctttgtaactagacagtgcccagagcttattggagcacctgtggtagatgtttctttgtcctctccagggtgattttctcacattcacctgcaaagacaaggatgggggacctcagagcctcagggtgaattaagagtgtggactttggagccgacttggctgcactggagacccagctccggcattcacaagtttttgtttattgttaagatttgactaataacccctccccrtgtagctcagtttccttgactgtgtaatgggaatagtcccwccttcaaagtgttaggatgaagattaaatgggttatacatgtaaagcatttagaacagaggagccgtagtcagctctcaataaattttagcaaaaaagaaaacactcaagtccctagaatttggattcggcatctgattgtattcaatatccagcatggtttcttttccatggtagggactcaccaaatgtctgttggatttaatttgttccagccaagcatttctaccactaataacaataagcaattgtgaaaaaaaatcagggatggaggcatagggaagaaattgaagcatgtcctgtcttaggcttcccatctgccctagagacatccatagtgactgtccccattgcccaggtgtggaagctgaaggccagagagaatcagtgactctccaatgtcacacagctagtaagtggtgaaacaaagattcaccggcctgtggtaaggatgaaagaattacaatgtggagtatgtctgagcccccattttgccacatactggcckacttggctaagttatttcaatctctggtgttctttcccaaaaactggagatataatatctaatatgtaggattagtgtaaaataaaactctttcccaaaaactggagatataatatctaatatgtaggattagtgtaaaataaaacagaaaatgtacatacagtgactattacttttcttggaagacagcagctgtttaacaaatatggttgttattactgctatatataaaaaaaaaagctttatcaaagacccctgtggtcactggtagccatccaggaagtcttgctttttatttatttattgactgattgattgacttttgagacagagtctcaaaatcggtagcccagactagagtgcagcagtgttatcatggctcactgcagccttgacctcccagatcaagtgatccgcctatctcagcctccagagtagctgggactacaggtatgtgccatcacacccagctgatttttttcttttgtgtgtgtgtgcagaaatggggtctcactatgttgtccaggctagtctggaactcctgggctcagacaatcctccacctcagcctccaaaastgctgagatcacatgcatgagccactatgcccagccaagcccagctttttagatgggagtttctgcttgatgtctgtggaggaggctggaccaactacctgggcagtgaacagacttcagccatttttattgaaagcaaacatgtgtgaatgttgttagaacacagatgaaaaggagtccacagacagaagggggccccagtggcattgtgctgaccccatacataccttagccatatttataatacactaacaatactaaaatgcacacataaaaattaagtctctatggctatgagcaatatataaattcaaggatggaaaaataactgtctgttaagcaaatgttatctaataactgcagcacgttagagcaaaacaagtattttccaaaattttgcctcttactcaggctttcttaaagaaacagggtaaaagtggacaattgtttgttggtctattctttagaatagactttattggtctattatttgtaaaagaaaatatgtcgcatatccaaaaaaccataccactaatatcatactcaatggtgaaacactgaaagcctcctccctaaggtcaggaacaaaacaaaaatgtcttctcttaccacttccatttaacattatgctggtgatttcagagcagttagttatgaaaaggaaatttaaaagtccaggctggaaaggaacaaataaaactacatctatttgtggatgatattaaccttttttgtatatggaaaatcctaaggaaaacacttttttaaaaaactaagaactaataaaggagttcagcagttgcaggatataagatcaatacataaaaaacaattgtatttctgtataacaataaaaaaatgaaaattatgaaaacaattccatttataatagcatcaaaaagaataacatacttgaggataaatttaacaaaagaaatgcaaaacatttgctcttaaaactacaaaacrttgctgaaagaaactttaaaaggcttaaataaatggaaagacaccctacgttcatggattggaagacttaatatgattaaggtggaaatwtccccacaatttatctacaaattagatgcaatctctatcaaaatctccgcttttttctttgcagaaatttacatattgatcctagcattcacatggaagttcaagggattccaaagagccaaagaaatcttggaaaagaaaaaaatatgaacacttacttcctgatttcaaaacttaccgcaaagcaccagaaccaaaacaatatagtgctgggataaagacagacacgaatcaatggaatagaattgagaatctaaaaataaccctcacatttgtggtcaattgatttccacaagggtgccaaggcaattgaaagaatagtctcttccacaaatgattctggaacaactgcatatctacatgtggtagggtgggacctctacctcacatcaaataaaaarttaaagaaaaatggtcaaaacacttaaatgtaagattaaaactagaaaatccttagaagaaaatataggtgtaaatctttgtggccttcaataaggcactggtttcttaaatatggtacaaaaaacacaagcaatccaagaaaatgtagataagttagacattatcaaaatttaaaacttttatgcttcaaaaaaaaaaggtggagacaagccacagaatggragaatggtaggagacatttacaaattatgtacctgataaggtctctctagaatatataaggaactacaagtcaataattaaagacaacaaacccaattaaaatgtgggcaaaagatctggatagatatttctcaaaagaaggtatataaatggccaatatatcaggacacctgagtgagaagacagatcctgtgcacatggaaagatgctcaacatcattagccattaggggaatgaaaattaaaaccacaatgagataccaatacacacccactaggatggctacaatcaaaagacagagaagaatcctcagatagtgctgatggagatgtttactggtgcaaccactttagaaagcagtttggcagttccccaaaatgctaaacaacagttaccatgtgatctagtaattctacttctaggtatatacactcaagaaaaattaaaacatatttgcacacaaaagtttctatacaaatgttcgtaataggattattcttttttttttttttgagatggagtctcgctctgtcaccaggctggagtgcagtggtgctgcaatcttggcttattgcaacctctgcctcccaggttcaagcagttctcctgcctcagcctcccaagaggctgggactataagtacacgccaccacacccagctaatttttgtatttttagtagagacggggtttcaccatgttggccaggatgatctcaatctcttggcctcataatctgcccaccttggccccccaaagtgctgggattacaggtgtgagccactgcgcccagccccagtagcattattcttcacagccaaagagtagaaagaacccaaatatccatcagctgttgaatgaatgaatggaatgtggcatgtcctgtccatataatgaaatgctatttggcaataaaaagacatgaagtactgattcatgcacaatcttgcaaacattatgctaaatgaaataagccagtcccaaaagtccacatattatatgattccatttccatgaaatgtccagaattaacaaatctagagagacgaagagtccattagtggttgcctagggattgagagtaagggggaattaggaaaagactactaatgattgcagggtttctttctggggtgattaaaatgttctagaattaatttgcaaaactctatgcgtatgccaaaagccattgaattatacattttagataggyaaactgtatgatgtgtggattatatctcagtatagctgtttttaagaagaagaacatatgttcccccagtgaatgaagcatgagagcttaagtgatgaactgccagtggacctctgagccttttcctgcagccgggggcttattgtatgaggaaggatagaatacctatagctgtctaccttgacacagaactttggatctatcatctattggatttccatggagccaaaggaagctygggaatgcccagtgatctattcagggtcagtcatccagggtggcctactttgagagcaaagagaattttgtgtctagcagattcatgggacactaccttggtcttctcactcaggtgtcctgatatatcccctcctctcaagaggtgttttctgagaaaagtggaggaccacagaaaatagcaagagagccccagaggctgcctgctgggcaatgtctctttctgraacatgtatctggctggacctggtaatctctgctcaggccaataggtggtgagcaagagatgaacaggcatttgggccatgggtcctctggcagttggttgaagcccacggacccctttctagaataatattttaaataaatgtatcaaataaaactcacagaattacaaaggaatccagtcatattgaaatgaaatattaaaatctcaaaaagtagcaaatatgtgatatcaaatataagtgcttcttttgggatattttaaaacacaagttctcatggtgcgccacctaaatgccataatttcaaagtggtgatcaatgtaaacaatattttgagagatctgtgacaactgtaatgtggtctgtgtctgtgatttacagcgatgacagtctctggtcctgctaacactgctctcggtatttaccttgccttttcttttctttccttttggaaggaaaggatatgctgtttcaggtgcagattagtgaaaatatagaagtaatgttttctccattcaagctgatgagacccctgaatgaagaactattcacttaaaagaacacagaactatttcggtcagttcaagtagaagcctctagaatgttattgtgtcaaggtgcgttttgccatgttagactctccctttattttctacaaaatatttgttcatagcagattatatttttattgaaaacaatgcatatttgaaagaaatgctcttacactcagaaacactgtccttggaagacaaagtcctcacaaggaagccaagaaatccacaagtgttgtttgagaaacgtcaactgtgcttcggctgttggcacacatctcctgtgggataagttcaggccttaaatgtatgcaggacaagaggcttaaaagtgagcatgtgcagagaacaaaacctatttaggcaggaaaataagataattggaactatatattttaatgctattttacagaagtatattataatatattctttaaatgcatgaaatgtgagaaattgaacaatgaaaatatmtatcactaatataactgcaaatatttagtgcttgcctttaattttttgtgaaaattagagatctgaacattttgttagcacagtaagtatatttaatatacctattatcaaattataactgatagatccagtggatggaaagctatggaagtaaacacacctaatatagaaagaaatactacttatggtataggagatatatatatataattgttacagtaggtagctagtcaggcctgagcatggcaggagagggctcctccaccaccaggaatgtcagrcaaccatcagatgatggtcaggcagttgttaactgtctttctaaaataatttgttgcagccagtgccagggaaagcagtctysctatcaatagaagaaacctcaaactggggatcagcagcttccagataagatctcaggagctgggtaagtgggctcaagcttgtgcattaagatgcaaaatgacagagtttaattggtatatgaccttctagggacatttgactggcaagggaagaatgcttgaagtgagcatgtgtacaactccagtaaacaaactgwgctggyaggccactgagcatgtggacagcccatcccaagggaagaatcaggggagaaaggatgcaagaccccagaagtatgccaacacataaaaccccaagtgaaaaagtcaaaccacgcacttgtatttcaagttggccacttggccctcttccaagtgtactttccttccttcttccctgctctaaagctttgtaataaactttcaatcccgctcgaaagcttgctagtctctccttctgcctctcagctgaattctttcttctgaggaggcaagaatggaggttgctgcagacccatatggatttgctgctggtaacatcattatctctgagttgaagcagcatgatttttactttcttctctttcttatattttctacatgcatttattttataagttaaaggctccactccttcattaaaaaaaggtaaaattattttttgataattgaaaattagtcagttcaaagtaatgtggctggtaatacacatcgcatttttgcagtctcttgcaaaacagaagctattctgactcccttgtagctcactaattttcaagaatttaataaaaatctgctgcctgaaagagccgctcctgtcatcttgagaaggctggggtctttgcaccccctgagttcagtgattgcttccccaaaaacacatttcacaagaggatagactttatcacatgggttcagccgggctgtgtcatagagacccatcccaactcaccccrtgttattaccagtgaactactgagatgctaaatctttggcttcttggtttgagttgtggaaggacagataaacaaaagtgcctgctaagacccagatatctggaggaattctgtggatgccctagagcaaggttgacgtgcygtgtctgtcaagggcaagagagtaaacatttcagctgcaggcctttcagcctctgtcataaccactgaactctgcctttgttgtgtgaaagcagcaagcctggtggagccccacaaaatcggttatctactgccagtagcaaacctccccaaaacttagtgatgagagcaatgaatattgaaaccctggttatctgaccaagtcagtattggacaaatttgcacagagatcttttggtgatttgcagaagctggtgcaggcagacttcttattttcatcaatatctagctccatcaggactgaaaactgcagactagctactctagacttctggtggctgagaacaagcctgcaggatggcttgacagctctgggtaaactgtctgagaacatcttcagcttgggcagaacagccttccaggaatgaagatgtcacagagagcagggtgctggagagggctttactctgaagtaggggcggccaatatttgatcccatcattcagaaatccctcttctacccacaggcctggcagtgactgaggctccatctagctctgggagaagaggaagggagtggcttcccactgggggtgcctcagacctcgcttacctccacccatagctggtccacccaccatgggtgctcaaaagtagaaggaaggatggggaaacattcagtccacgtccaaatcatcgagaagacttttcagattgggaataattccgaagccagatcccagcaaggcactgccaaaaaatggctctctggggtttattttcctttggaaaggacttttgggacatacggcaagagggagctttctgggtcccttaaagggccctgcaggaaagaagggcagtgggacgcattgtctgttctccatagacaatagggcagactgcttcctccttgggactggtagttacgtttatgtttctgacaaccagctggcyactgaagaagcgtggagccaacagctgcaagggataattttggcagcatcacccacggtgcaaatttaaaactccagctggttctactgcaagcagaataaacacaaacagctgataataagtaaattcagaacttgaaatatgccagagacactttatagccctctgttttctcctagtgtgcactctttgtgctctcatcctgtggtcttgagcgtgaacatcattttcatattttatcttgctatctaaaagttttatttatttgggaaataagtaggctctgaatctggggggaaaatagttgtcaagaaccaaatatttggcttcctgtttcccagaaagtgtttgctgctgtttccatttctggcccaacatttttccagagttgaaaatgtcatttaaatgagtcagtccccggggctcagaagcaatgataaagatgtggacatggccccagaacgttggagcactgctgcctctggtggactgaagggcagctggcattaaaaacaggatgttcctgctgtgatacaggcagaggaagaagaagggtatgcaaaccaaggcagtcccctgcagccttgcccctcagtgtgtggtcccagaccagcagcatcactgcacctggtagcttgttagaaatgcacaacctctgaccccaccccgacctcctgcatcagaatctgcctgttgacaaggtcttggggaaaagggtattggggaatttgctgcacacacactccgctgggcaacccaacggcctcaatgagaccagcctgcacaggattctacctgccttcccctaccttccaccacagtttcaatgatcctcttaggagtatgaaaaaggagtggccaagattgtcagcatcagcttttatcttctctctgtgaacacatatatcacttaccaacttgtcagaaaggcagattcctgggccctaattcaaacttcctgaatcagaaactctggggattgggcccagccctgtgggttttagcaagctctccagggcattctgatgcacaggtttgagaaacaactggctcattgtatgtgaggcatgaatgaagtggcctccsaggctctgctcacatcctcactacccycatctcttcctcctgggctttccaccttgggtcctggctctaccaactcttccttggatcctgaatctacagtttctacctgcatgggcacaagtatcacaaaccttatcctgatgggatagtggaactccaccttcaagccaagataaatgtaatttgtaaaatttttgcacagacaggaggtgcagaggacattgttatcatgaagctgaaagtcatgcaataggatggaaaggaggaagactgaaggaatccaagatgctaaaagtattaagaattcatagcccaacctcatactgttgggctatgagtatgtcaacctcatactgttttctgcaaagaaacagagataataagtgctttaggttttgcaggccacttggtctgtgctgctgtaacaggagaccagccgcagaccatatataaacgaatggatgtggctgtggtccaataaaactttgtttacagactttgaaattttcataattttacatgccrtgaaatatttttcttcttttgatttttttctgaccattaaaaaaatgcaaaaaagccatttttagctcacgmaccatacagaaacaggcagtgggccagagtgggcctgcaggccatagttttccaaaccctgccctacaaacattaataaagaaaaaaacttagaagatgcaggacttgcttatgaaaacttcctctacttcaaaaaagatatatatagagaagaaaaaaacccaaccactaagaagcattgtattcaaatgcaagagacaatggtgggaaragccctctttgtcttgtttctgtccattgtggatgtttcttgtcactgttgtggaattatggtgagtgaaagagagggcgttaagaaggaagagaagagaaaggaaaagcaaaatacagtgagtatttaggaagttgtagaaggcaaagtaaggactgaaatgaccacaagcttcatattacaaggagagagaaaaatgtggttctgttctttcagttaaagagaaaaacgcttccaccttactccccaatagaaccacagatctcagagttggcttggctgagaccaggcctattggattcttggcttccggtatcatgcagcttctggtaagtcaatgtgtttgacattcctccacactctagactccccagctcccaaggaaggaacaccacctttcatcttccaggtcatttcattctgctatgaaggtgtttccatctcaaaaattggtagttcatataaagcgggcaaatgggcgccatagtcaccaccttacagacactgcactcatttacacaccattttgcatacatttgttctgactgctcttcagtgagaacttcattacttttatattacagaattgttatacttttaaaaaactttaaatatcggtcatttgtagtgagcagcttagtattttccgtgatggagtgtaatagttttccattgctgctgtggttaaaaacaacacaaacgtatcatcttagagctctggaggtaagaagtccaaaattggggcaccatcagggctgctctccttctggagaatataggggaggatcctttccttatctgttccagagatcacctttatttcttgacctgaggctcctagctccatcttcaaagccaagagcatacacagcatcttctcacctctctctctgacctctgcttctgtgtcacatctctaacccttctgccttgatattccatcttttaaggaccctgtgattgcattgggccaaccaggctgagtcatagaggcaaaagccaataaaggattaataacaaaaccaaagggaaaaaaatcctttgacagaattgccctagcatgtctggtttagcacgtgagcaaatacagcatttgggctgcgtcttatgaaatcttaatggcttgtgaatgaaatgagttaaaactatcaaccatctctcgctgaactgagcttagtgttcccacttaagaaattcatttctgaattttattaaatttttaaaatctcactaaaactatagtcctgtctgctgatttctagggtagatggccctgatgatgtaataaatcctcttcatcaagaatgtcttggtcatttgtatttctggcactgtagtcctcacagtagagcatcggtcctttgtcatctaaacaaaactcacttggatttagcagcaagaactttaaggactctgattgtcggggctgtgatcctaagcttgaaaggatcagtttattagcaatatctcacactctttttttttttttcatgttgagcagtagaatataagagatgataatgaggaaatggaaattaaagacgtgtgcgtgtgccactccctgcagattcggtttataccatgsctccaggagtcacagagcgttggacacagcaggatgggtggtctgatcccagctatttgcagcccacacagtgatcaggggattctttattggtcacttttttttctttctctctaccaattaatgttccttgttcttgatccacccctttgagccaaacaaccattgaaaagatggaaacatcattttccatgaaagtacacatcttgaaccctgttataacctgaaacagaaaatgtaaaaagctgctgtcagttcctccttcagtttcagagtgcacacaaagccctactgtcaaacttaaacaatgtttatagtgaaaagaaatgattagaagcaggaaggcaccacagggagtaacaatccttcatgtttggagggattttatttgctttagcaatctgatggaaggaaaagaaaattcccattatcaggaacatcgcccatcggagtgcctagtaataaaagtgtcagcaccaataatgttattaaaagaaaacactttctaggttctgccacctacgtgttgtatccctttaaaaggaagcacagtggatagcacagtgcctgtagaggctgagctggacgtggatttgtttgccttgaagctttgtatcaacagtatgggcacctcagctctgaattttctgataaaatgaggtgtgcacgtagagttcatggcaatagtgaccttcagactcattcttcttcagatccttctttttagctagatctacaatggcattccttttcccaggaatgcgattcccaggctggccaaactcatgttgccatgtattamcccccaaggcaaatagcaaagtttcctttgaagacaataaatacatagtccatgggctggacaactggaggtgttttggaaagttctttttattttcagcaagatatggagactcactttccttggatgagtataaaacatgaaagcagttattctgtagatgtctaatggaaagctctagaatctctaccacatttcttggtgccagcatttgcattttttggctatttattggaacttggttgcatgtcattttttgttcatccatgccattttctgactatttactttgtgctaggtgccatattaaggacattaagcacattacatggaatcctcacaacaaattatttttattatccctattttactgaagatgaaattaatttaggaacagtagcctggccaaggtcatggggcagcagtgaagccagaattcaactgcagggctgtgtaactctgacatccagcatgtaaccacatctcaatccctgaaatgatttaagcaaaaggaagcaaatgagaagaaatgtgtgctctttatagttttatgcatcatgtgtgggtttgcctctgagatgtgtcaaggccctgttgaaacagtcttgtgagatgttgcttccgaaagacgtagaagcacagctgtgtgttgataatagtcccaaactggtaacacttgggtgttcatcagcaggtaaattgatacacaattgttagtgaagctgctcaggggaattctaggagcaattaagagtgaacgcacatcctatgatgtgcaaatctcaaaaacattgcacagcataaaagcagctttacataaaacagtatattctgtctgatttgaattatatgacgtcattaaacaggctaaataatccatgatggggggaaatcagaacagtggttgcctctagctggggagaaggtaaaattgagaagggggatggggaaacttcctagggtgatggtccgggtccttatcttgacagggtgttgattacacagatgtctgcatttgtcaaaactcatggaatgacacacttaaaatttgtacatttaattgtgtgtaaatcttatctcaaaagaaaaacataacaaatatcggcctctagttaatgacatgggttgacatgtttagagggatgtgtactgatgcctacaacttactcaaatgcatcacaaataagctgtattgatggctgggtggatggaaagttgtgacagaagtcaagtgacatattaaaagtgtagaatctagatggtgttcgaatctaagcggtagaattctacctaggtagaatccacacagctgttcaccgtttgtaaatttttctagcaaaatattaggaaaaagactttgcttatggagtccaggctcttttctctgtgaagctgcatttccccaaatgtcggggagacccacctgccctgttaaggaccagcggtgatctcaatctgacactgccacagtgaatgccacaggtgttctgtgccagtcagtgattcacccttgtcacagttggggaatagtgaaaggaagccttgaggggagcagtggaggtggccacggcccacctgcccagcagactgatgcccaccactatcctctctggagacaagtttggaataagagcatgattctgaggagtcagacagacttcagtttcattcctggttctgacagctgcttgctttgtgaccttaagcaatttgttgaaatacatctgagcttctatttatccatctgtgaaatgggcacaacgcatagtggctggcacaggatggaggacggtccttagcacaatgctaggcccacagaatatgctcaagcacatttcctagaaactgaagggcctgtacaggccaaaaggcctgtagcccaaaagcagggtttgactgtggccatctctaagaaagaaatgtagtcagatgattcaaaggaaaatgggtaaaagaaaaaaaccaaagctgcaagtttaaaaagtcaatgctcaggaatgatgagaggaaagtggtcttggaacacacaggggtgaccactccttcatgatgtgtgtgtgttttgatagaggtcggtataattagagatattcatgatccccaaaggcctccttatggggtaggggcttaaagacattttccctactcttggcccttccccactcaccctccctctgaccccagggcccataaagctactggagccttgtgtttggggctcagtcaatagtgaaaggaccccaacaacctgaccctgtattggtgcactacagttccatgggcaaagagaaacaagaggggtcagcattttctctggttgagactattgcttgtaccatcgcaataagtgattaaaggctttaccagtactttcattttggctcattgttgctttaattggctactccaacacctgacagctcagctctctctctctcctgctcagctgaactcctgatactcaacagaggaattaagatgcaatagtaaaatatacataaaatttaagacagctattctgcagaagactctccagagacaatgaaaagaccagccacagactggaagaaaatatttgtgaaatatatacagtctcagatggggataccatctgagaaatacatcgttaggcaatgtcattgtgtgaacatcatagagtacttacacaagcatggatggcatagcctactacacacctaggctatgtggtatggcctattgctcctaagttacgaacctgtacagcatgttactctactgawcagtagaggcaattgtaacacaatggtaagtattcatatatcttaacatctgaacatagaaaaagtatagtaaaaatmcagtattataatcttatgggatcatcttcatatacatggtttgtcattgattgaaatgtcattatgcagtgcatgactttatctgatgaagggctaatatccaaaatatacaaagaaaccctaaaactcaacaataaaaaaaacccatataaaaatgggccaaggatttaaatgaacacctctccaaaaaagaggcacaggtggcaaagaagtattgaagagatgctcaatagcacatgtcattagggaattgcaaattaaaacagcaatgagatatcactacatacctaatagaatggctaaaatccagaacactgacaattccaaatgttggcaaggttgtagagcagcaggaactcattcattgctggtgggaatgcaaaatgataaacgctttggaagatggtctggcagtttcctacaaatctaaacatactcttaccatccagaaattgcactcttaggtatttactcaaatgagtagaaaaattatatccataaaaacatctgcacatgaatatttatagcagctttactcataattgccgaattttggaagcaaccaagatgtcctttgctaggtgaatggataaataaacagtgctctattcagacaatgcaatattattcagcacaaaaaagaaatgagctatcaaaccatgaaaatgtttagaagaaacctaaatgcatattattaagtgaaagaagccaatctgaaaaggctacatattctatgattccaactatatgacactctagaaaaggtaaaactatggagacagtgaaaagatcatggtttccaggagttgggagggaagaagaggcagagcacagaggatttttagggcagagaaacgattctgcatgacactgtgacagtggaacacatcattagtcattacatgtttgtcaaaatccatgaaatgtacaacagtaagaataaaccctaatgtaaactttgggctttagttaataataatatgtcaatattagctcatcaagtttaacaaatgtaccgcaccaacatgagggaaaccaaattatttctcccaaaatattgagggttgttcagctaaaaatgccacaagcacagggaagcacttggcctcggccgctgtttggctgacggcagcacacaagcccttccttactgaagacagcactcgcttcccagcccagagagggcatcagcaggcacaagagacrtctggaagggggctttactatcttcccagatcttcctgccttttaaaagacaagaactgctctcctctttgttttgtcactacataggatttatggctctttgctgaaatactatttaaccaaggacccctaagccattgccttcagaaatacttttggactggccgggcacggtggctcgcgcctgtaatcccagyactttgggaggcagaggcgggctgatcacgaggtcaggagatcgagaccatcctggctaacacaatgaaaccccgtctctattaaaaacacagaaaattagccgggcgtggtggcgggygcctgtagtcccagctactcgggaggctgacgcaggagaatggcgtgaacccaggaggcagaggttgcagtgagccaagactgygccactgcactccagcctgggcgacagagcragactccgtctcaaaaaaaaaaaaagaaagaaagaaatacttttggactaaggcttcccctgtgtgatgggtactacataaattaataaacttctgcttgtttttcttatgttaatttgacatctgttttcaggagagtttctcacctaataacgtaaaaaggaaaagaaaggaaattatgttttctctcccacaactgcaagttgttgaaacatcttgcgggatgggattggaggaggcatatatgggaattttctgtactttctacctaattcatctgtagacctaacgtttctcaaaaatgaaattataataatttaaaaaggatacttgaataaccccaaagaaaacaggaaaagagaactgaaaggaagggaaggaggaggaggtggargaggaaggtaggaaaggtagaaaaagaaccgaataacaggcctaaccccaataaatgctgattctatctacgaatacttctaaaacaggccaaacaaatctgtggtgatagacagcagaacagtgtttgtctatggggtggaacttgattgcaaggagcataggaaacttactaggggtgatggatagttacacatcttgaccaaagtgatggttacaatggtatatacatttatcaaaatgcattaaattgtacagttgggattcgtacctttctctgcatataaatcttacttcaactttttaaaaaggattaaaaatgcttccttggtgagcgggacttctgtgtgaggcctgtaggcacagcagccatgctgtaggcacgaggatgcaagccacatgctcgctggtgcggaggaccaaaagaagaaatgcagccgaaagcagctgcagcagccctggctttcccacctctgaatttcttgtcatgagagaaaaataagcattatgttaaccaggctttaatatgcacaggcaaatttactgctaaatattataagtttattaacatatttagatataagcaggaccagaataacatacctagaacagatactgattttcttgcattcatgtaataatcatttaaaattcatatctgctttaygcgaatagatataaacatagagctaagtgctcctacaagatgaatttttagtaggctaaacagcacagctaaagtctcttatgaacctcatttccccaacatatctttcatctctctctctttttggtttgtttcttgtttgttaagctaatgggtgtattaattccatcccaatgtgactccaaattttgaaattataaggcccaaatgaattattttttctttgctcaaataggatacatacctcatctgaagacaattcaacatataacaaaagttaatgaacggcatttcactgcagtcacaaacccattaagcatcaaatccaggcgctgtgaacatcaaagaagtcaaactgggcaactggtctctcctgtgcaatgggaaaacctcctaatgaagggccatgactttattgttgacaccgattccacttcaaacttggcgtctgcaatctctgccagaagattttccgaggttgtttttaagtcataaagttaaataacatgaaatgttgtctccatagtaaaagatgctttcctaaaactgaagggcctctagccaaaagacctacagccaaaaagcagggtttggctgtggccatctctaagaaagaaatgtagtcagatgattcaaaggaaaatgggtaaacaaaaaaaaacaaagctgcaagtttaaaaagtcaatactcaggattgatgaaaggaaagtggccttggaacacacagaggtgaccgctccttcatgatgtgtgtgtgttttgatggaggccagtataattagggatattcatgatccctgtggtgctttggtgggaggtggaggaggacagtcagagacagatgtcttcccagtctccagtgctgagcagaggatttggtaaagcaaccggcagtggataaagtgtagaaagtacaaaactaactccagcccacaatagtcattcactttttgataccactgaaatgacgaagtcaaaagcaatcatgtttcccacttctagaaaaatattcaggtcacaatttgtaaatcttttgtttaatttataacaatgattagcagcatttaaaaatcaactttattgaggtttaatttgcatacaataaaatgtacccattttctgtgtggtctaaggagttttgacaaatgcaaacgcccatgtaaccaacacccaatcaagacacaagtatttccttcattccacgaaggtccctcaaggtcttttgctcccaaccctcacccccactctcacataaccattgaactaccatccatcactgcggattagttttacctcttctagaatgtcatagaaatggaatcakgcagtgtccagctaattttgttcctttgtgtctggctttcttgctcattgtgtatttcagacgcctgctccttttccttgataagggatatcccattgtgtgcatgacccacagtcttcacccagctacctaatgatgaatgtctgggttctttccagatcgaagctgtataaataaaccttgtgaatatctatggccaagacaatgtagatcatggcttcattcccttaaataaatatctaagagcagaattgtcaggttgtacgttaagtgtatgtttaactttctaagaaagaaaccatctgtttttaaagaagttataccgtttacatttctattaccgtgtgcaagagttccagttgggaagtagcctctgagcaggtcgggaccatggggcgatttgcacattcccacttcccttcctctcctactgcattcaaacacattgctctcaccaaggcagactggggatagccacgtggggggactgtgagggtgcgttccctgggatctgccctcagagcaggcaaggcaggtctcaggatgcacaatctttctgatcagagggcttttgagtagttctaccccagtgtgtgtgtgcgtgtgtgtgtgtgtgtgtgtgtgtgtktttggggggtacatacacaagcccaagtaagtttgtttgaacatattattaaaaatacccatattgcttaacactctgcttttcctatctgaaactggctgagaggcccactcatctccccactctttgctggttgacactttttcaattgcagttcctattcatgtctaatgggaggcagggaagcctagtgattaagagtgagagtgtaagatttcattcatctaattcaccactcatcttctctctgcctcaatttccttaactataaaatggagatattaatactacctatttctcaatagcaaatactattttcccatttggtacatagtaaaaggtcagtgatttttttcctcttcattgctttaataacatatgtggtataaaataacatatccggggtcttgtatttaaaaaatcttttgaggcttgactgtgagcaaggcacaatacagatgtacccgttgctcttgagtgccttacagtctctcaggaagacacaagtcatgtagccactgacctatcatgcaaggaataaagtgataaaagccagcagaaaactcctgagagagaaatccatccccatggatacagctcctcctggggaaatggaggcatgacctctagaggcagggaggactgtctgcactgagtttagaggacagctgtgtgctggaggctgccagtgctcaacaaatcgtgcttgcacttttcactgtgctcaggtgaagtacacctgccagggcctgcatctgtacctgaaggtttccccatcctaagtgtggaaggccactttgcccacatgtgtggtcatctggaagtgctgggaattacccgccaactccacccagggcagccctctactcattaccaatgggtatctacacaccactcccttggctttcagatgtgatgaccctggcatgttttgcaccatttcccaggatttctacagtgatgtcaccacttgatgccattaccactgttccctgtgcttcccagtgaaccacaggatggtgagtccttctctcaggctctgtttctgggagctggagtgcaaagagccccagaccagctggatatggcggccacaattcagagcagcaatagtgaagacttgagtgcaggccgtgccatgagctggagacaggggacaggtggcagatggtggaggaagaggccctggacagcatcgaggctcacacaggcccaccaggagggtgtgctagcccaccctacctggtacactgctccaacccccagctcagtcatgcattccacatgtgtttactgagcaccacagtatgccaggccctggtctagaggcctagggtatatcagaaaccaaaagacaaaaaagtgcccctgttggctcttacattctagtaaataaatacagatactaaataatcaatcatagtgtacaaacagaaatcataaaccagggtggaaggtgattggtgttttggaaaaacagtagagcagagcaaggatcgctgggagtgctggagagaaggcccagccttatagcccactgggagaagataggtacaaagtgaggaaggaaagaaccatctaaaattgtttccaaaataagagagtcaagacaatgaacaagaaggtatactaacaagaataagagaagatcactcaagaccaaatgaagcagcggttctccaagggcggttcctggaccagcagcatcagcagaaatgcagtcttgggctccaccccagatcggccaagtcagaagctctgagggaggggttccgttttaaggagccctgcaggaggttccagaggattcagacacatgctcaggttcaaatacagctagaaggaaatgccctcctgtgctgggaagagctcacctagtgcaggcgggaccagaaaggaaccacacctgcaacctgaagcgaaacctcagaactcaacagagaataagaaaattgccaaagcactcggggaaaaatggaaaagaaaaagaaggccgggcgaatcccagcactttgggaggccgaggtgggtggatcatgaggtcaggagttcgagaccagcctgaccaatgtggtgaaaccccgtctctactaaaaatacaaaaaaaaattagtcgggcatggtggcgtgtgcctgtaatcccagctactcaggagggctgaggcaggagaatcgcttcaacccgggagacggaggttgcagtgagccgagatcacaccactgcactccagcctgggtgacagagcgagactctatctcaaaaaaaaaaaaaaaaaaaaaggaaaaaagaaagaaatggtccatgaaagaaaacacattatttgacatcagccttctcatcagtaacaacgtatgcaagaaagcaaaggctggatatctccagagttctacaggacaacagtttagagcctagaaatctatgtctaggtgaggcatcattcaacttgcggaagggaaaggcatttctggtcatgcaagcatgaccttctcagaaaaagacacaactcaaaacaaaacactcccgtgataactgaatccaacagtactgggaatcagaggtgaagatgagaaaaaatcaacaaaaactcatggcatccaagtaggttttggttgtaaaaatgtataacaataaaaaaataaaattcagatgcaatccaggtgggcagtggtgtgggaatctgggtaacctgagaggacaggaaatagaaataacagattgctgggtattttggggaatagagggaggagatagctattaattaacacaagacattaatagaagatataggctttagtatgtgaggtgaaaaagtaagactatttgaagaatacaaatagtctatatcaattccaaaatattaagggaaaaagtagatcaaagaaaacttaatcaatctaataattgacgagagagaggctagaaatcccaatgaatcattataaatggaacatataaaataagtcagtacaaatttattagtaaccttaatgaatgtgaatagattgaattctcccattaaaagacaaagacttttgattgaataaaagaaaaaaaaagtgaaatccagctttgttgtttacaagagacaaacatgaagtgtcaccagaargctgaatttagggaaaaaataccagatattcatcagatgcagcagaatgaatcgggtatatcagttgtaaagtcatatataatataatttgaagtgaaaaggttcaaaaaggtatattttttattggtgaaggaygaaatctgccaaacacatattagtcccttcaccacgcggctgtaaatagaagacaaaactggtggaaatccgaggagaagctgacgaagccacagccatgggggatgagggcctggatggaggccagggcatgaggacttgcaggacggatgagaaggaaagcagacaagggcgtgacaccccgacaaacacacgygggacaggaggcagcgatttcaacaatgaagtaaaacatttgtgatataacgtttttgggaaagccagaccctggagaaagaaggtagacgtcccaattattttcttccacctcacaaatttcattatttcatgatacttgaacacagtaggagccccacagagacaggtcacaggcttggcttcagaycttacaatatgaactatgtggacaggcgtaaggccagtggcagaggcaagcaggctttgcaggaaggtgacaggagggtgctgggcctcaccaaggccagcagaacgaagtggcctgaaattcgcaccggcacgccctgagaaactcagcccttccttctcaggctccaagcccagctttgtgagacctgattgtgaccaccacacctgggacattcctctacccccttttgtgttctctctctctcttctctccctcatctctccttccttctctttcccatttattcattccctccctaccattcattccttcccattcattcccttctttcctccctccctccctccctctccctccctcctccctctccctcccttcctccctctccctcccttcctcccttcctcttttcctcccttccatcctttcttccactcagttgaattctatraaccaattttaaccacaagagaacatcatcatccaagttaatcacgacaaacctcaaatagaacccaactaccagaactcagagagggacaaccgctcatggagagtttggtggtggttctcctggggactcaggagagggcctgtgcctgagctgcatgctgagcacccttaagtcaatcacagttccggaaaaatgattgcacttgatctataccttttactctctctgcctctttcttcactttttcactgttgagctgttcataatttcctctgaaaagggagagttaggaggcattcagaggatctgaagggtaaacccattagtcattctgtttctaagcacctgtaatgtcaaatataattcagggaaaggctgactccgacttctctggttttcaagtttatcatctctgctctctgtatctcctcttgctgaatatacacaagagtcagctgagaacttgataggctcactcaatgcatgttcaatcccacagaaggtacatagtacatgtctgagtctctcattgtaatctgcattttgtctgatgatagcaacacaaatgtactctgcattgtgcaatagatatgtgtgcaaattaatttttcttggcaaattatttgtttgcgaatgatttacctagcatttaagaaattttagtgagatagcaaaagtcaccaaaaaatgtaaccatcacaagttggtgttttctttcataggcttttcctaaattgagaaacactggcctcaggtgttccagtacgacacagaaggatgttagaactgtgtgtgcttgtgggtgtgtgtcttgtgggtgtgtgttgtgtgtgtttgtggatgcatatctctgtgtcatgcatgtgtgtgtttatgtgtgtgggtgtgtgtgttgggggaacagccatggttgttcatatcgaggaataacttccaagtgtatgttgttaatgaatagacttctaacaggatcagctgcatttaaccctaaataatggatatttattgcaagtgtcctgtaccattagcataacagagcagaaccctttgttcttcttaagtcctgtgcctttgccacagccttttgcacaatcttaaaagcaggctgactcagaattgaccaccatctgctgttcctgacttggaatcaccatgagatttgtgcagccaaacaaccagcgatctgatctgcctgtccaattagttaaataaactgaaagggctttgctgacaaagtagtgataaatgctccaatgataattatagaacagtgttttcacatcgcatccattggacatgtttaattctgcgccaggcatcacccatgtaatttacaagatgcagagaattaaagagtgatgagggggccatggatgagtggactcagctgccatggacactgggcgcagtgcagcccagccctctgtattccatgtccccaagggcagcacgctgaggggcagggtacacatttgctgaggtaatgaaggaaggcagagcccagcgccccctgtcgcctccagcaggtgcaggtgcagaaactcagccacaaggtaccttctttttagcaactctttgaaaggggagatggataaatgtaatgaccttgaaagcaagttctgccaggtatttcgagttgtcgtgaaatatattaaaacaagttcacaatcaatgtgtttaagagtttattaggataggcacataacagaaagctcaaaggacaacaaagctgcaccttcctaaaggctgaccctcaaagcaccattttgttagaactcagaggagaagctcgatctctgagccttccctcctcacagtttgggaaacatgcacaggatgaaggtaaatcctgcatagaaatcttgtaattccagaattagtcaaacaaatttgaaatacacacatttaaaaatacttacattctcatttagcrttcatgaagtgattactgacatttacaattacatctgacatcacagagcaagcctttgcagggatctaattcaagcttaagccaaatctatgcaaagaacttcagctcagaggaatagtgggcaaaatctgctgaaaagaactgcttgccaccttgcagataagagcaacagcacaataaagggattccagagcttctacctaaaatagaagggcattatctacaagaacagaccaaaacacaatttatttttaaacaagcccttcagtgagtatttgtctcaggaatctagtatgaaaatagtgtctttgattagtgaatatatggagaattcggattatcatctctatttttagttgagaaaatgcacaaaccatatagatttaaaccatgggttttgcagccgaagtagagacagatgttttctgggatcatatctcagattcccaagctaaagctattgttcaaggtgatggaaatatgtagggggcattaaaccattttgcagctgctagaaagctgtgttttcctgttttcctgatttagacaatggagaagctaagaagagaaataataggaaaggctttcctatgttagttttaaaaagactgtgttatttttaattcaatttttttttgtcaaatctcatctctgttctcctagttttcacagaaatatttacaggaataaaggttgaaacaaaagtacctaatgatcatctccatccatcgaaagattgctcagggataagacactcaaacaagggcttgtgatgaggatggaaaagacaaagcaacttgaagagaaaaaaaaattcttttaaactcagttcatcctgcaaaatggacataacacatgcatataaaggtttgactttttaattccacttttttgcctgatcgcagggaagatggcatgtggctggcccttcctgaagccttgctcctccaccactggctaacagacaggcctccaggtggccttgcaaggccgacagtgaccgcagcccacttccccacatccttaatcagagcctcatgcagttcatccccacattacccaaacataacgtcgtagtgctacacgtagatgtgttgcatcatgatgctatggcaatgacgatgacgcttaggtgtgtgggccaccgaaggcagagaccagatgtggttggtcttgcctggaagccaagctgttgagcaggggtggagtccctctacagaggatgctcaccaagttctaatgcattgtcgataactgtcctgccctggtttttctgcattcctcagattatctgtgggaattgtcctcctgcatcctttctcaaatgacaaagaagaaagaaagagcagtgatggcacctgaaattcaggaatgagtaggcatggcgagctgggtgtgtgagatgttctctctttacattgtctgctttgagatgtgggatgaggggagggagagagttggtcctgaatatattcagttttttccaagagtctcccagaattattgacctatttggacaacaaatcttcattgtcttggtgtccatctccaagtgaaaacttcccccgtccccatggccctggcttgttctgctgctgaacaggtcacctgggcagaaacactgtgtctagcgagaagttagcaggtggcagggtgcacctctccccatactgtgacccttggattccccactgtgccacgcccgagcaagctggggcccctcaggacaaggacgatttgttaatggcctcttggccggtgggcatttgtttacccactactgtagccccaagatcccccaaacaagaatttccatgcttcaaagtaacagcaaaaataaacaggagaataaagcacgtgtttgagcccagtggtttccatcagatgcacaacctgagctgtctggttgggttgctggctctccccccgtggtgggagtggtgtgcaagagaaagcaccacccagcaggagagggacccagcctgccagggaaggttttgaggaactggattctttatcacccatttctccccttgtgggttccacagaggggttccatgacctccctgttgttgagaacagggctgcattcagagaacagacgatgggcctgggctgtgagagcaatcagaacactgtgaaaataggagggctcgttggatcccaggaatcatacacagactgcgttggggctgtgggaagccaaggacagaaatgtctccttcaccccaaatgataagggcaaggattttcaaggcccagagggagaaatgttgcatttgcatttatttaagtgctgatgttggtcagcagcgcatccagccatgtctttagaatcctctgaatggccagacagatggctgctctccacaccacagactgcccagcttcacacatcacctagagtctcgtggccaaggaagttttgccaaatggacacagcctttgtctcccttaagtgttaaacaccagagttccaactgaaaactggagaccatgagatgactttaaaaagaagttccaaatgccccatcgagccgcacaaaacctccatctttcctttcacttcccctgcccctttagttttctattaaaaacaatctgaaccatagcatctatatttcaaaactggcaagagtattaaccctgcaccttgtggcccttcaaccrctccagagtgtcacctcagagaccgatgcattgctaaggcaaaaccagaaacacccyttctctgaggctttggggccttggagggagacacatttcctctgtctgttctcctgcacagtggtggtaaaaagcccacaggagacatgaggcctcccagagatactcaggtaacttctagtgactctgaccatcggtgacccccaggaatgtgttccagtgccccaggcagaatggtgccgtgtctgtgtgtgtgtgtgtgtgtgtgtgtgtgtgagagagagagagagagagaaagagtgcacactatcgactacattatcatagggagaaatatttgcaaatgtaacttttaaaatgaggatataatttaaatggctttgagcagtttttgctgtaaaaatgattttagttagtcatctctttccctcttccttccctccttacccccaattttaaggaaaagagacagagaacaaaagttccttaagcaaactgcctgactagctccctacttggtgtgtgcgccacccacacttcaggatttaaaatctcaggatgctgcatcaactgtggactatgaactgtgctaaaatgctttaaaatgacaactttcaaaacacagtgcatcatctcccgttcacacatcctttaggaaacagcctgatggaactttctgcagggcttcctctgtctgagctcggagcactggcattccgggcaggatgaagtggaggcggggccacaggcagggtgtctgaggcctgccctggctcaaagacaggttgtccttgaatttgtttccttgttagtgttgatcacatccgtagtcaagtgtgtggtaacctcagtacatttggatgaattaattcaagtatctgtgaacaaatccctggcctctctcgccctagccccgtagattatgtgacttcacaaacacctgtaatgcacttcaagcaacttttctcatatttttcaagcttcctttgcaaataaacccaaggctattagaaatgtaagaactaaagaggcacttcctgcctccttgccacctaagaggttaattgcacttctggccattctggaggatgtcaacagtatcacatttagcaagacttgtgctggcgaaatggaggaatgcaaatgtaaagaaatgtttccagtccgaacatgttccctttgaccaaaaaaccagatcttcttacctaattgaataattaattgatttagttttcatcctaggaagagaaacaaatcatttcaatcctaatcagcatgagcaactcaccttttcctcttagatggtggaagtgagcagagaagatattcaggggagccccttagccccrgcctcctcacaccctgatccggaattggtcacattggaatttgaaaagggagggggagtaacaatcattatagagtcacgaaatccccaccgtggcacgccaacacacagcttccacttcaggaacatcaaacacccgtagaaaatacctgcatgttccaaggggcctttaaggaggagacttacaattgtttgctaagattccagtccagtctttcaaaaaaatgtgggtgcccctttggaatggggagttcaaagctctgaggatggtggctggtgwctctagtgtctctagggccmcctcactttcagcagtctgtcccaggtgtcggactatgggaaacaaaacagacagcgttggaagccatggcgcctctgtgcctgcacgtccccaccttgggagagagccccacgtgcggccgtgctgcagatgggcagtatgctctaagggggcccgagtgcctggcgtggggggaggttgaggggtcagctgcaaggaccagggtgtgtctgcccacaggaaacctgggcytgctcttgctgccacctctttgtactgtagtcagtgcccccatgcctgcccatcccctcccccggtcactcagggccccctttacctgtactggttctccatggccctgctctcagctcgctctggaacccaggagtaactgtctgccgcattctggggcttcttctccttcttctcctccctcttcgctctccgcttgcgatagaccagtagccccagagccagggccagcaggagtaggatggccaccacggtgcctaggatgtagaataaaagcagcttttgcccgtcagtgccatygttgttttgtgyggccacggaggagtccccacctgcaggctcctgggggccagaggcagctgtggcgtgatggatgctgggctccctccagacgcctgrggacccactgggggccagcatcttgagtggggcagatgtgatgggggcgtcagatgacagcgaaggtctacttgtggtgggtgtagccttgggggtgccctcggggccccttgtgggactggctgttgcagcrcggggcacggtgctcccttctttctctcctttgtcctcctcatcggggggcccagatggtggtcccagagacacaggccccatggtgcaagagaccccatttggggccagcacccagcctggcaggcagccacagtggaaggacccttgtgtgttgaagcacaagctgtcgcagagggggccccccgggcccacacactcatccacgtcctggcactgagtcccgtcctccccggccaggacgtagccctcctcacaggagcagtgaaatgagccatctgtgttggtgcagccctgggcgcaaggcgagcgacccagagcacactcatccacatcctgacaggccccctctccaggaccgcccggctcatagccaacccagcattcgcagcggaagcccccaggggtgttgacacactcctgggcacagggggagtcctggcattcatccacgtccacacagtccagctgactcgagtccagctggtacccttgggggcagcggcacgtgtagtttttcccatggggtcccaggacrcacgtggcccccccacgacatgggctggagctgcaagggtttcgagaggcacaggtcaccaggtcatccagcagccggaatcctggtcggcagccgcagaggaaggagccatcccccccttcaaagcagtcctggtggcagcccccattgttgaagttgcagccatacttggggctgacacagagggggcccgagctgccccagtcgaacacatcgggggccttctccttgcacaggaaataatgactctgagtctcgtccttgtcaccttccccacaggctacattggccgcagaggcaaagggcacagcctccaaggaggaactggtggtctggaagggggtggtgtaggtcacctgacctgggccccccagggccagaggccggcacatgcctttgaagctgaacttgcacacgaagccctcaatgttacttccgggggagcctgggctcccacasgggccctcagaccacttggggaggcggctgggaaggagcggctgggacaggtccagcagcagagacacacagcgcttggagatgcacgagttccggagctccttgtgccagttagagtaaggcgtgtcctccccccygcccacccagctgaagcccttcagcggcagactagggtccaggcacttgcccttctctcgctggagcccaatccagaacttgctcatcctcgccgtcagggctgcctcccgcctcaggagctgggccagtactcgctggacgtgctgggcctcctccttgctcttcacagtggccaggttgcccccgttctggttgcagtggttctgggcctcggcagcgctcagcttgcccgagtgggccgtgtagcaggcggtccccacgcagaccaccgcctccgtgtcagctcccgtccccgccccgggctgggtcaggagcagcagcagcagcagcagcaggcccatggaggtggccatcccggtctctgtgtggccctctgygggaggcgagaagcccagcggcgacaggagcttctatctcggctcccagctgggccccaaggggagctgaggggtgagctgcagccactccggcgcagagaaggacacaaaggctgagggctttccacgtycccctgacccaaggcgcatcctgtactgttgtacttcttatttctcaccggatgttggggcttcctgcaatgaatagttctctgactcctgctgccttcatcacggtgctgttgttcataaaaggagtcaggcagctctgccgggtccctggctcagcactgtggaaacagcgacggggggaagacgttacagccccgagatactgccggcttgattttggctccattctctttctcatggcatgaggagcctcggaggcatgccatggagtgagcaggggctttgggggctaggaactcgaggaagctcccttagtaacccataataaaattccactttggtttgcaaaccaccaaaagagaaaaaaaaaattctgagacttaagacacaaggccatggatggttataattttcagccttttttagaagcaaactggactttccttttgcctagctcatgttctctgttgactttgggagccttttttcttttatcctcccatcgtgaaccttaaatagacaggcattttttaaataggatacgggtcgtgggaatgtctgggttttcaacataatgccaagctcctcgataatgttaatccaaattgggtgaaatttggcagttctgggggtttcatagtggaaatattgcattgtgaggtgtcagggtcacaaaaagcatcagaaagaaaatgaaaatgtgtccggcctcgtggcgcagggcttgcaggctcacttcccccggctcaggattcctagcaagggccggaaatctgggcagggagcgggaatcgaagcccgggcaggccctccygcgacaccgcgactcggcaaaagccagggactcacagtgtgcttttcctgcagccacagacctttgctcattggttgggatcccccaggaggggaccctgagacaggatttggggagactagtttatgtgggaggggaagtgaaacagacaaggaggaagccaacccatgatgacttgctgagaaggtgaccctgggctgctggagccagtgccaggaaactctgggggcctgaggggaccacacctcagcaccatctcagctgagggagaggctccactgctctccaagtcccctgtcattggtagcaggctgtatctctcactttgagagactgactataaattctagccctgcccagtgaccaggggtctctctcacataaaacttgtttctatggacagacacccttgtggctctcgtctgacccatgtccagtttattcctatcaagacagccacttcctaagagatccctgatgggaggagagttgggttggggtgtgggtcaggggagatgcaggaggcagcacaagaagacacaggaarcaacacaagcaccgtgtcacttacagatcccagggagagggcagtgcaccccacggggccagcaaaaagtggggagctgtctgggtcacaaacactcacctggaggggggtgaagggagagagagagacctgggtcctaagcctttattggggtccaggacgtttcccaagcaggtttcccaaggggacttctcactggtgggtttagagcaaacagacacgggctccgtggggtccctgtggctgagaggtgggcatggcrgcatgtctgggaagtccctgtggggtgtggagtcactgagaccatcaaatgggctgtatctgcctgtcccacagggaaatggtcaccaggaggtgggtgtacaaggcagatatctgggttggccgcattgaggaactgggagggggtggagccctagacaccgtgtcaagagcaataaaccctgcttctggtaggagagggtccaaattagattcaaaatggatgcaatgcacaattataagaattctctacacagcggcaactctttggtgctctgcactgaccgtgagggccccaggggaagaagcgccacggtggagaacacagtgaacgcctgtggacccggcaccagcgaccaccacagtggcctccatggagatgttgagttgtcccgggggctaggagctcgctggctccccaagggacaaggaggcatctctgactccagctggatacctcctaagaatgtgccttaagtccttgcattttagcaaagatatttgagacattttgggaactctccatagaagccaccagaccctccctgtgccccttcattcatccatctgtttgtccatccacccatctaacatttgttgattaagaccctgctatgcactgagtgaggcactggattccaggaggggatccctgcctctgtgatcctggagtcctgttagagtggacaactttgaacaagtcacggcactgatggctttattgcaggcagcacaggggagcggggaggtcgtggttgatacaggggtggcatcctgactgggggatgggcaattaggagagactcctctggagaagacaggcagtcaagccggaatctaaaggagaagcagctcagatgtggaatggtgtcgggatgggggaacagcatgtacagaagccctggggacagagagtgagtgaagggcagggagaccaaagcccaggcagtgggagggaggatgcaggggaagatggagccctgtgaaccccagtaatgaaggcttgaggcttcgtcttgaaatccacggggaaacactgagggctggcatgaggcctacatgtggaaggggactggtcagtggacccaagcagtgggtgggggggccctcagcaggtggccgcaggtttccaggctgtggagtccaggtcagatgttctcggggctgggtggaggtggggggaagggcaccgggcacgcagaaggactgcatggctcctgccgggagctggggtcctggaaggctgtgtccgctggaggtacctggttctgagaacacaggggattgcctcttggggctcagggtctcccagaccccctgtccttgtgacctgcctcctcgggacgctaagtgtgccaccagagctgggtaagcagccagctgtgaggggtccagggaaggctggtgtccctggctcccagtcaatatagctggccatgcatttgagtttggcaagggtcagtcttgttctctgcttgggagaagcttcatttctaagggtttatttacaagcaggtaacttcttaacattctgtaaaatcaattctgcagccctagcatccactcatagcagggagccgttctcgtggtctaggcccctgtttgtgcagctcggaggtagattcctcagaggtagattgtgatmtgcagcattcgctcagcattctacttagttggtgcttaaggatatgggctaaatgagtgactttcagcatgttagccactctgacccccagatctttgtcaagatatcttctttagctgtaagttattcatcttccatgtgggaactttcaaaccaattactgttcacttagccaagtgatgacatcttaaagaagaaaatgaactagcaagacatatactctgttttttatccattaaccttggaagtatttgtaaagcaccaacagtgagaaagactatgtaaaatgcagaaactgccttgccctgggggtccttggattttactttattattttcagtaacttggttaactcagccccacttctcatctataaatgcagaggtgggaacagggcctctggaaactttcttgctctaacattaataaaagtgaaatcatgcttaactctcccctctggaattagggagaaagcaagttgggaagagagtggacactgagaccattgctgagccctcgacatactgcacatgtaagcaaacctctgtctaaactgcacacacccaatttcatcccaaattgacccgctgactgccaagacacagggtagtttcctattccttgtcccccacatctgacttccactgtgtcccttcaccctttggctgatccctgctgggctcaggtgggttaattcacctgggacacttacagctaggttctctagctccagccccgcccttctgtgtccgctcccacctataggggacgctccttagaggctgttcaggggattcgtagaggctgagggcatggtgcttcgacctcaggggaggatgaagagcttgcttttcctgggagggatttggtggagttttacaaagaatttaagatagtctgaatgcaaactttgagggaattctgcacctcacatactaaattccccatggatggtgtttcatcccattttatttagagagcagattataccagacctctccaaggaccgatacttaaacagcaggaatcagcagaaggagatggaaaaagtttttctcggcagatctttggacggaagccacgttaggtgttctagaaccatggcgagcctaacagcatggcatgtaccctgagcaaaaggctcctcaccatttgtgtgtattctgcagtctttatgagtactctgagctttctttttaaattgccttaaaaatttactttgcacgatgctggaatggaatgttctgatctcaaatatggggcgagtttaatctcagttatttgggagcagactaattggtttgtggatcattcaggcatccrgcctgtctttttcctttttttttttttttgtaactaaaaattaaattaaaaagggaaacaaagcacactgcgtatttcctggcataacatggtatatggtagactcacaatgagcaacagtggcacagaaatggtggaggaaatgaaacagaactggagtcactgtgacctgtcattctatgggaccacttagggattttgtgttcaaagtttaaaacagaaacagagtgaaaactgtgagacctgatatttttgtttgtcagtacagattttagttcatacatgaggcgcttaacagaatttgaataacatttttgtaaaattgaaatttgtcctttattaatcgtttgctttaaaacttaaaaaactaggaaaatcactaatattgattatgacatgatgatttctgaaagtyattgtgttgtacagaggtgaggggtgctacaaggttcaccctgggcacaaagatgccaggattgctgcaggcaaccccactcgaggacacccgtctgcccttgggggaggctcatcgattgaccatctgtcctgcattgagagggatagaggctgggggcagtggctcttgcctataatcccaacaatttgggaggccaaagtgagtggatcacttgagcccaggagttcgagacctcatctctacttaaaaaaaaagagaaaagatgagtggagtgtggtggtgtgtgcctgtagtcctagctactcggaggactgaggtgggaggaggattgcttgaaccaggaaggcagaggttgtagtgatcaagccactgcactccagcctggaagatggagccaggccctgtctcaaaaaaaaaaaaaaagagagagagaaaggctggaacctgtctgcactgggttacaatcccactctgtgacttacagctgtgtgactaaggtcacgtctgagccactctgtccactgttatatggtacagctatctgtgactccacaccctcagctgtctccgactctcacagggctttgtgagggctaagagagtgcatacctaaaagaagctcagaaaagcacctggcaggaacagtgaattcctatcacaccaggacacggtggcctgagaccaccctgactctactcccgcaactggaactggggcctcagccagttgctggctttgggattgggaccaacactttcacttcttggggccttggtttcttagtttacaaaacagggaggataagagtcatgatgccgctgtcctgtcagtgggattaaattaaaagaggtcctagtggtaagtgcttcctgcaggggctgacacgtggccgacatcagtggacaacagtcatgtcaatctgattgcaatgagcagagacagagcccacacccccagggcccatccctgccaaggcaaaaatgaaaaggagtaaaacctcccttatgtttgctggagacacggagcttgtatttttcaaaaacttccctggctttagagtgtttgtttggatcctaggctgggtaaacattcttcttagagtgttattgatttttccacatttagtaaatagtcttctgacataattaatcatgtaccatatttatagaaaacttggctgggctgaatgttgtttttgaggttaacttgtgctcacctcttgacactggccgtgataagcaaaggctactcaccagcctttggaaagagataaatcatggagggaaacagagttttcagcaggatcgggttcacacatttgatctccagggacagctctgagcatgaaatacaagtctctaaattatgctcacacagctggtgtggatgatttcaggttccatttgacattaacagcatcctcagtgattccagtaagttgtcgtaacaatttagccatatttagacaatataatttgatagaaataaaaatgatctatttagcctaacttgtcaagatctaattcttcagaaaaatgagaacaatgacatcacagttgtttgaaaagaagtcatttaatttgaatagataagcctgcttttccgggaaaatttaatttcctttgggaagctgactggggaattctgaagattcctgaggagtatagactacaactggaaaggaagacctcacaagcactggttgagaaccctccagtgctaggtgtatttaggtccacacccaggaacccttgggatgagggtttgcaaccagggagactgtccaggagcaggaggaagcgctgggtctcagcccagtctcccaaggccaggactgctgcctttgccttgccgcatctcagtgggcatccccaagctccactgacttagcacaagatgggaataatagyccctatcttctgtagtttcaaccactagtcaaaatgtgccacttactagccacgtgcccctgggcaaacaccgttcctctctgggcttcagtttccttacatgtaaatggtgtcacatccacagaggcatgaggattaaatgagatgactcagtaaagcgcttggcatagtaggtggtaagtctgtggttccacgattagtggtatgaatacaatctcacatttactgaataacagttctaatgattatggttattatttttgccctaggtgattctctggcagggaagtcaccaggaaccctccagaaggaagaaatgtctagcatgtcctaggtccccgcacccttgcaaagacccagagatgaagcaatgctggatagaccccacctgcacacagagaagaaaggctgctggagagacatcatcagaggagagagacagtggctctaatccaagaatccaggcaacrtgtgtagggctcagggtggcatgtgtgtgttttcatgcccagcaccaggacctgagcactgagagctttccctacctgccatgggatcctggtatcaaggtgttgcccgaaggtttcagcaccatgtggtcaattgtccatgcatctttatgccaatctatcatccccgctgctgggtcccagagccattcaagttggtctgaggcattcagggcttgccatctcccagtgggcacaaggcagctcccctgcaagaacacttcccagctttgatgacctaaccctccttgctggggtgcagataaaggacacggcaggtgcactacctctgtaaccctcactcaaatatgccagtctgtgggctcatatgccttgacctccaaagcacagacatgccagctgggcataagctgggacccctttggaggggagccagaagcattcagagccatcagcaaagcagagtctgcctctctgcagggagctgtctgtggagctccctgtgtgccctgatggtaggattcaatcgctccacagaaacctggaattctccctgttgtcctgaactgtgagaagccaagtcctgtgttttagatacaataccatctgaattctgctctcactgctggcccatgttctgtggcttcagccgagtaattcmactctccagggctctttgtcatccatctgtgagagccagtcygggcagagaaggagaggagcagggcaagctgagaatgcagcccatgatgccgccccgattatggtgtttcctcactggacacgtggatgaagcgtgctcgggttttgacatctcataaagaatgagctgacagaattgggtttgattcagtcattttgaaaataagcgaagttgctttttgatatcctttttgtcgaaaatgacaaatagcttgcctttgtgtatacctgcctcgtttctcagtccggatatatctgtttcttaggaagtggggggaccagcaggaggggaggaacatggctgtctcatggccccagcagccagagaaagcccccaggtaggtgctggctgtgacatcaggtccccgtgcactaaaatagtggggagcaaggagcatgggtagggcacatgcccagtctgcccctggtgaaatgacagagaagagcccttcctagttaggcattcaaatcacgactggatcccccaatacacaaaggcgtggttgatgtttccatgccagatcctagcacggaaagctgttcacccaataagcgtccacccacgcccccacttctggcctgttccactgatgaaggtgcccgtatatgtatctgtctgcccatagtggggtttctttgcctgcttttattttaccagtggctacatttcatcatccagcttcatttcccatagaagttctgaatgttgtctggttttcctcgaaactatgartcacactgtgcacgccctacctctctctagcattgtaagaaaagcactcctctgtgcaggacacaatcctgtctactgcccctgagagccctggttcatctcgtccctccattccagttccttctagaaggtaaaagttggaaagtgacctgagcccagtgcgggacaatatggcagtgctcttcaaggcctccgctggaacatcttgtgtctcccaagctggatgctgtgcctggtcattggagaaagtaaaggcaaagcctcaggacagcttccagacaccagtctcttcatcgggacgaggtcagctgctggctcccaggttgggtccagctcttcatcatttactattagacccacacagtgttttaaatatttcagtgaattgtgcatatttaagaaatgtgagattttacagaaagatttgcatttctggcttttctaaaaaaaaaaaaaaaatcaaagtgtcttgcaatgctggcaaccagcccaacgtggcaatcagtgcctgcattagcttcctccttagtgccgccaggctggctcctgcagccctgggagcctcaacatcactaaatacctataacacaatagcctatgcatcttctatcgaaagtcatgacagttcttcaaatgaaagttagctgggaactatccaggattctccctataccaagcttgtccaacctayagctcaagggcccatgaggcccaggatggctttgaatgcagtccaacacaaattcataaactttctcaaaacactatgagatttttttggtgattttttttttagctcatcactatcgttagtgttagtgtattttatgtgtggcccaagataattcttcttccagtgtgacccagggaagccaaaatattggacatcctctttataaagcagggagggtccttctaattgtaacatcttatgaattcttgaagactctacaactgttactctcccttattcttcttaagaccagctccactgtgcacctgatgctagtaagcgttgggacgtgctgggagactcccctattcaggggacaaccctgacagatctgagcaatgatgacatttctgtccccagctgacacctggctcaggagggacctggctcaggagggacacagactggcccatgtggcataagggaaagttccatatgcttctgggaaagtcccccttgctcttaaacagagactggagaaatggccagcctgtcctctgagtgatcttctgagggctggtgtgcaaagctgctgtggtcaggacaagctggctcagaaaggtggcaaaaagagggcaggagctcgggtccccaaaagcctcctggaactgtgggattcaccaaacctgaaatgatcccacctgagacttcttatatgaaattattctcattcttaattgtttgagcagttatactttggttgttacttgcagccaaaagcattttctccagacttctgagtcctaaaaatttcattctttgacayaagagctgacccagaggccctgaagcccctctcaggcctgcagagctttggtctgtttgctgaatcagattcatatctacacaacagttctagggccaaattctgctctcccacactcccacccactcatattggaagacagaagagtcttctagctgaactgtttctggtgaaagagtagccttccttcgcgggcactgacactgagggaagcagctcagtggctacttccacctgcagatattccaggtggtggctcagaacwgctgacaaccatacctggggaagactggcctttatttttctggttgttcatactccaacagctagcaccgtaygttggggtccaatgaagcgagcagcagtagatggcatggccagggcaaggcagacacgctggagcagtcgggaaacctggcatctacacccatgcactggcaccctcaccttcctgtttcccgtgggaacaaagtgggcggcaaatgcagggtgagatactgggtcacttcaggctccaacttgcagaagctgtttcagacccacaacgggagcaggctgcatcttttgcctactcaggataaaacgtgacactgctgcgtcatacagagatagttctgcatggtttcctaagaaaggcaaagccagaatgcccggggactaccagcattttacctgagtaattaccatgtgagcatgttatcttcaggaacaattttgctgtgctttaataatttatctctgagctaaaaaattataattgaaaatgataagcactttcacgagttgggttgccacactgcaaaaccaatttattgcacagaagattataaaacacatttccattcaactcagtctcaagtgatgggcaggttggaggggctacagaaccacagtagtattaggaaactgcacaactcgtataccaaataaaagcatcaaggatatgggggcagctggaaagcagccctgctctggttgagggttactgtcgacatctccctgtaatacagcaacctgattcctaaagaaacagatacagtaggcacttcactcaaactaatgctctcctcagcccagggcaggggagctcagccacaggccaggtccagcctcagctttgccagatccttgcacgggtcatggaggaggctcctggacccgtgcaaggatctggcaaagctgagatccaggccagcacagcccagttctctcctcctgctgcagccaggctctcagcacgtgcattcacccccactgctttccatctgcccacttcttcattcatggctgtcctttctgcctctctggtgtcctggggctgctttcacgtcggcctcctctgacctctgcaggccaaccacatgggccccatcagtcctctgctccctgaccctcaggcatccctcctggaagtgtccagtgtgtgggcaccaggtggtccacattccctgggcctcttccctgctctggcctccacagggttccctcctgggccctgtctctctcctgcccaactcaccgctgctcggttgcatccactccccacatgtctcctactgccccatctcgcggcctcacagatgtgcctgtccacatcaggcctgtcctttcatctcccaatcagagcacccagctgtccactatttcccagaacatctcagagtcaccaagacccaaactactcycacttcctcccccagtccaccatccgtccagtgatccacgacgtgcaggcggcatccttcctcccaccttcccagcctctagggatgatctggctccawgccctgggccagtcctctttttccccgcccatgccccacctccaccgcctctcacatgggtgggcacagcactggtgtcctgaccagcccctggctccagcctcatcccctatgctccatgctgtaaggtgagatcatgttgaaatagaagcctgatcatttgttttcccataagcacacacaccacagtgaaatgctgctggggcttgccattgatcataggataaaaatcagatttttttttttttttgaggcagtctcactctgttgctcaggctggagtggcacgatctcggctcactgcaacctccgcctcttgggttcaagmgattctcctgcctcagcctcccaagtagctgagattacaagcatgtactaccatgcccagctaattttttctatttttagtagagatggcatttcaccatattggtcaggctggtctcaaactcctgacctcaagtgatccgcccacctcagcctcccaaaatgctgggattacaggcatgagccgctgcgccaggccaaaaatcagatttctaacacggccctgttagccctgggactttggtccttcttgttttcttttttctttttttaattttttttgagacagagtcccgctctgtcaccaggttggagtgcagtgacgcgatgtcagctcactgcaaccttcgcctcctgggttcaagttattctcctgcctcagcctcccgagtagcagggactacaggcacacgccaccacgcccagctaatttttgtatttttagtagagacagggtttcaccatgttggccaggatggtcttgatatctggaccttgtgatctgcccacctcagcctcccaaagtgctgggattacaggcgtaagccaccgtgcccagcggatccttcctattttcatgtccacattccccagccacagttctgtgggccacccagtccttccacaaggccaatacacacacacgcacacacgtgtgtgaacatgcatgcagactgagtgactgatgaactcttttaactgcattaggccttggggagctttgcccatctycccactgtagattcagcctcctggttacatgctctcactgcaaacctctcaaccttgctcctcttcctcccagaactgagcatagtggtaactttgtatatgtgaaattgatctcccarcagtaaactgtgagacagtcagagctggaaactcatccctcttgtctattgctggctccctagtgcctgctatagggagcaagtgatcagtaactmcttgatcccagccatacatgggaatcacctggggtgggggacaaaccatagtaccaagccccattctggaccaactatatcagacttgctgtgrgtgaggcgcacgcgcacacacacacacacacacacacaggtgattcttacaccagctctgagaagcactgaggttgggaagtgagaggtggagagcttgctagcatgaatattgatgtcacagcgtgaatcttcactgttccttgttcctttccccaaggccaaatagaagagtcccagatgttctaactagctttatttccccaagtgtcagcatttggccagcatgcctgaagatctagaaactgcagcttctctgccacatacagccaatgcttcaccacccgccttgtgcagggagagcaagcctcagctttgcctgtacactgtgctgtgcacaccagatccccagcataggacagtaacagcacaggcactgcaggggacttcagggaggcctgaatggccctggacccccagcccagacttctgtgcagaagagttaagagttattgagtgactgcaacctaaaggatatttcttctttaggtcatttaactacactaccagcttcttgaagccaggggctgcgtctcgtggaccttattgtctgctcagcaataacacagggcctggtgctttctgacgaatccacacacatgcactgagtggagctgcgctcacggatgagcacagctgcatctttcacggaggctgctttcctgtcagcttgcatttccctggatctctgtgtactgtggagtacagggccttgggctgagcccaaagcattctgagcaaagcatgcatgtatgggcatgtatgggaactaggagttctaaaygctttcccttaccctgtccccttaatcctcttaccaacctgcaagacaggtccttccacagtttcatgtgagatgagtaacggcagttttctcagctgttaggcaagctgatgccttgccaagctcaaacctggaagactgatgttgaagaagcaaggagggttgaaagagccatgagtgaacaaggagccaggagtgatggggagccagtagtgatgggggagccagaagtgatgggggaggagccaggagtgatgggggaggagccaggagtgttgggggarccaggagtgatgagggaggagccaggagtgatggggagccagtagtgatgggggagctaggagtgatgagggaggagccaggagtgatggaggagctaggaccctaacttatacctggagtagaaagagtagggacatgaggaggagcatccactgaaggagtttatgttcctttttgacctgatgtgcctccagaaatggagcctgacagaaacgggaatctgcagccaaagtcctttgccctctcttggtcaggctttgctgtattaattccatgttcatgcaaacatctgtgcatgagtgtctatgacaactgtattcacaatagccaaaacctagaagcaacccaattatccttccacaggtaaatggttgaaagtggctcatccatactctgaaatactactcagtaatacaaagtaatagattgatccacacatctacctggatgcgtctccagagaattatgctgagtggggcagccataaccagaggttcatgttgtatgcttccatttatgcaataatcttaaaatgatattctatcaattctttcaatggagaacagactaatrgttgtcaggggttaaggtggggtggagtcagggggcaagtgagtgtggttaaaaaaggacagcaggagtcatcttcatggtgacagacatgtgccgtgctctgcgacagggtcagtctcctagtggtgatagtgttccatagctttacaaggtactatcacaggtaaaactgggtaaagggtacatggaatctttctgtattatttctcataagttgtatgtgaatctgcaaatatctcaaaataaaatgttttattaaaaaaaaacaggagagattctcagggcagaagtttayttatacattgcataagaactagatgcaagtggctttgtcacctgttcgctgcagggaagtcacacccgtccaaagggccaccagcatccacctggatctcatgaaccaaaggccagtgctcattgcccagccccgcaaagctgaggtgttcagtggggccagagctgcaggccctgggaggggtggggacaagctttgtgccaagaaggtgcaggaagccatccagcagggctttgatggtgcagtgggcactatagcctctaccatcctaagaagatgctggaactgtcaacacaatagccagtcctctgcaggcgctgtctccagaaagttctgttaaaatgtaacacactacagaagcaaaggaacaccattaccatcataacatcagggatctgcagcacttcctgtaacagcctatacactaaatattctcagcttggcaggccactggtctctgttgcaactatttaagtccatctttgaggcttaaaagcagccatagacaatatgtacagcaatgggcatggctgtgttccaataagaccttctttacagaaacaggccgcaggctggtttggtccacatgctgcagtttgcccacccctcccattattttatatgatgtttttgtagtttgcggggcttgttggccccagccaccactgagggtgcatggatacctcttagcaggttcagaggtggacctctctaactgaagggaagcatggggcagctgagggccggataagagcctggggttctgggaagggtgctgaagaccagcttggatacccacactggccctgtcaggggtccttagagccagatgggaataagctaaaaatggggtgagatgttttagccctcagtattgatgtcaacggtgaaggtgtctgggtctttctccccctcatgccagctaagggtatgttaattcaccctgaatctgcccaggtcaatgttcaagactgtgcaccaggaaaggaaaacacttcatggagcaagaaacccagggctggcctagctatggccctaacagagcactcactcctgcccagtgttgctggaaaatcaggggccgattgaaagcgccttccctgggttgtgtgacagtgagctctcaccactagacaatgggatctttatctgccttagggattttagtaaaggtgatctttcacagtcttgccttaaggcaaaatcgagccattgttctcatgccttatttcttcaaaaccttctgcccaggccgggagcagtggctcacgcctgtaatcccagcactttgggaggccaagacgggtggatcacctgaggtcgggagtttgasaccagcctgaccaacatggagaaaccctatctctactaaaaatacaaaaaattagctgggcgtgatggcacatgtctgtaatcccagctacctgggaggctgaggcaggagaatcacttaatcccaggaggcagaggttgtggtgagccgagatcgcaccattgcactcagcctgggcaacargagtgaaactctgtctcaaaataaataaaaaaataaaaataaaaacaaaaaataaaaataaaaataaaaaaaccttctgcccagctcttgcctgcatctggatagaagactcctggagaaacaaacagtagaactcacagaccatgttggctaccaagttccttctctaaagcacacgaagacattgggaaatgactcaaatgccaggaaggaagtttaaaaaaaaagtggaggagctcatttaaaagaacaaaaaataatgacaggcaagctaaaataacaagaaaagatatgacatcagctcagggttttttttttcctataaatgatgccaactcccactcagaagagttggagttggagaatttttccttggcgggtaggggagggaatgtgtgcagatgctttctgtgaaggtgggataggtgacttcctctgtgcccggttacctcgcatatgtcatgcccagcagccgggggaatcttcaccagctgaacccatcacataaccagctcctagatcaagaagcagaacattctctgctccctagacccccgggtcattcccccaggctccatactccccgctctgacagcagcgatggtcacgttgggctgttgagcatccatgcatgcagggtgtgtgctctttgtatctggcgtctttgggcaattcatccgcattgtgtgtggttgcaggctgttcatctcactgctgagtattccactttgtgaatatgccacggttttgcaaatctattctgctattgatgagatttagatggtttccggattttgttgtgcatgatttgagggagacagagaagggcccaccactccctgtgatccatctgagttttctgaaaggcttccctccaggcaggttgctttgcaggcatcactctcaccccactgttcttagccaggggagttccctgaggggcctgcacaaagttgttatcgactccccgacactcaagcaccaggggcctttcatcccagcagaagggagaggagaggtaactggggcacgttttgcgccttcaccattgtatgtctgagtcatgatgtctttacaactcctyagaggtcctccgcatgcaattccctccaawccactsacaggcagcctgaagacctggttaggtaccgggtttgggataaaatagacarccttgccctcaaggagctcacagacaagttaaaaactccaaaaccaagtttgattgatgtaatgccagaaaatgtagccagagtctggcatgcgagagtagcgattgagggtctctctcagggaaggaggggaaaggggtgtagcaggaaattagaaattagtagagaaatcaaacttgcttcaagaaatcttaagtgaccgactgcactagacatttattacatggaaagaggagtcactgagtaatggtattggtgtagaatcaagtaatgattgtgcacaggattctcttctctttgtggttcattgaattgttgtgacttttatataatggcctgcagaataacagtgcacctccacaaaacctcagttcagcctaaagggaggctttgttgaagtgaaaaggtgtttttgaattttcctgttttctttggtttatgcgctgagtgctgattcccatgtctggtgacttgtcactcctcgatgaacagaaactaccagagacaggagtgggccaagggagttggcgactgtgaggtgaggtcggggtcctggggaggagggtggagggtggagaaagaataaagaaagaggatgtgctggttaacattgagagttctgactaacacagagggtctctgtgctgatttgctccagataccacaggaggtggccctgtcagcctggaaccggcatcgggagtgcccgtgggaccatttgattgacactttgctcctccagttttctgatcagaccgtgacttttagctgtgatattgtccaggcctgccaaagtccactatggatgccaggttcagggacccattctgccctgcagttgacccttgtctcctgctcaaccctgaagcccctgcagtgtgtatagaccctggacccactgggctccagcactgcctgtcacacccctgcaagccaggtgaggctggctcaggctggtgaggaagtgcttgtgaggagagccagggctccacgccagggtaagagtaggaccaggaacgatgtatttggttattgacttttcctgcttcctgagctttataacaacacggggaagagggtcctgtgatcatctcaatttacagacaaggagactggggtatgtagagaccaagtttttgtgccaaggctgtgctcaaggtgagattcaaactccaggctctttgacttccctacactgcctgtgccgcaacctcgggagcagaaggtccggaaatgtggggcaagaagtcaggggccggggaaagagccaatgtggtcaccattctgctggaggtgggtctccaagtgtctcagctagcattgccctcaaagatgctcagcaagttctttcacagtaagaaatttcagagaaactccaaggagcttctctggaagagaacatctggggaatgyctggcttccatgcacccagcccagtgctggttgctagaatgcatagcaatgacctatgagcagtgggcccagcaaattattaactacagcttttcaggaaaaaaaataacccatttgtatcatttgcctctttccgtggtataaatacctccaccagggtcagcttcagtctccycatgatgttgtggagcatggagcagggaggaggtgtgagcagcctgccgcggaacaggaggctccacagatgcagataaccttaagagcacaggttgcagtaaaaatcatcaggcatgcaggttttactatttattattttaaaaaatataatttacttacctgtaggtttacaaagtttatttttaataatgactgtgtttaagaaccagcttgtgagattcctggaaatttcacaatctgctcttgcaaacaagcctaagtcagcccaggccggctcccgtacaccaccaggtgtgaggcctccagctctggaaatctgggcagagaaggggtagcatgaaaagaagtcagggttaaccctgtttaaccctggtgcttagttacaatgcctaagcatagaatgataaaaccttcaaacgttagtgtcaggggatgctgggcaatcactggttctacccctgcaggtagaatggaggacttcagttcaaccggccagctacgctccaagcctaatatggaagtccaatgttttcttctgctggtgtggtgcagggcacggatttcaggaagtttgtcaaattgtttattctatgagaatcaagagccaggatattgtgtcagccttgcctgtcagctgttgtttatatcacactcggctcctgtctctgggcttctttgcagggccagcttcgccttgctgggtgccctgccattctgctgtcagtggagcactgctgaccacaagaacaatcgagcaaaggctgtgctgggaggtgctggcaaagcccatgagagaaactagaaaaattcatgtttcatagacccagagcctctttagagtttcacgcacagaaggacctgccatgtgagcagtggggctgcatggcccagcctgagtgctttgctctaagctgacctttggggtcgtgcactgtagtaacttagggctgcatccatcctgcatgaggctgctttcctcttctcaaatattacttgtttaaaacctactttcagaaagacaactagattaggaatcgggaatgctgtgttatcgcaaagctggtagcaattttaaaatcttgaaagaagcttgtttccgctgtgagcctcagtattcaaatatacttgtttaaggtattaaagctctagctcactgatgctataagagtaaaaatggcaagatgtgaacagatttttaacactctgtgtgttaagatctgttagtcaccctcagcctcggcattgtccacatctacatcatctgctttgacctggagcaaacttattgactctccaaagacctcatttttctcaccttgacctggtgataacccatcacttggaaaagcttttgtgggttacatcagtttccagcaggcacatggctattagggggactcagcctcttggggataaaaagcaaagcaacttggagagttcatggcgccrtggggctgcaggaaggaaggtagccctagccttcagccccagaactggctgcaggtgaacaatctgaagacaatcaagtccagactggatgtcagggtcccaggggtcatgtggtggatgattagagaccagagtttggaggagttatgccaaatccccrgaagcatggaaatcccccacctctgccgaatgttactggattgtgagctccctgccctgcagctggtcagtgaggctcccacaaatcagtactgacaaatccacatccaaaaagcccactcatactttgtagctcttgtacattatttgtgatttaaactattagtttctctccctggtttaaagaaaggtgcttggggaattttggataactgaatacctgccatccctagatggtactcccaagtctatgagaaagggaggttttaagagaccagaccaggcctaagttgatctcttacaccggagagtgtgatagagttaggggttttgtttgcatgcttttcagttgtgattttaaaaccacctacctttctctcacccatagtcttgatacttgatgtgaggaataaccagaagaagtcaaccctgctaacgtcacatggcagggcacacaagctggtggctgtgttattttccaactgaaaaatcatttataaatcattaatatatggattccaccagggatacatacaaaaaaaaatggtttagatagaggagcctactcaaacatgctcaagcctgtgtgcagacatagactcactcattattaaagcttaccctggaaagagccacgtgaatctttttgggaacaatcatcccatgctccagctggagggaaccggaggcctttttcttcggccttttgtttcacagatgcaaagaaatcagatccagaaaggttaagtgacttgaccatgttgaaacatccggttagcgacagaagccaaactaaaatctaagttgtatgtgtgtgtaagtgtgtgtgagtgtggtgtgtgtgcacgtaggtgcacaggtggaaaatctgtgtgtttttctccagatcctcgctcttaagagagtccattctaagacaatcatcttaattacaaaatcagtgttctgcattaatatcatgaaaccattattgaaacaaagtagagtattgtaccaattcaacaatagtagtatgattaggtaaactgtcatgtaaacacatgatgtgttatgcatcaattaaattatgttggcaatgagtttgtgcatatacaaggcaatgtttatctttaaacattcaagtaggagaaacccaagatctgaaactcttcagagtaacctcaactatatctaaaactttgcagaaacctgatgacctgcctgcagtgagcctctctgggtagtagactatggatgactttttggttccaaaaacatctctgtattaaagtacaattcctaaactggaaggaaaatgggaaggtgtaactagaagcttgcatgcgggctcctgacctggagcaatttggtgactttgcctgttttgcagctctggtcagcaccttggcacatccagggaccagaggttgcaagaggacctctttcttacaaagtcagcagttttgttccatgtctggcatgagttcagccacacaaggatggctctggggttgaaagtccccttttctggcttcctccggtgtgctttactgacctacctcagagaccacatgtggcccttggggcaggttctcaggcaaacgtctgccccactccttgagagagaaaatgggctcccagtgccctggactttgaattcctttgtgtttacttccccaaagcatcttgagaattcacaagcttctaggcttttgctgtgacctccagtgggtttagaatgcaccacgcaccagagaggagaagccaaagggtggatgcgatggtttccagccctggctttggcgtccagtgggaaccgggctgtctccccctgctttcccctttactgaactttagtgtggcttgtggtagaatgcagtcagttcaggctctgtggccacctgctgagtaaagactggaccctctcctgaggtccaggcaggccatgggaaatttgagttatgttcattaaacaatggcaatctctgcttttcattttcctgacttggagggacttgctggggcaggcaacacgcccaaggtatttgttagcaatcacgatatgttgtatggtgggctcggccagatatgggaggaagctgaagtcctccatgctgctcaaaccaaggacactgcccaccgccccaggactgtacaataataaacaagtccttccactgaacactggggtgggggaagcagaaggtgaagctaattttaagtgtccaggaacttatttgaaacaatcttgacccaaactgttctgaagttctgtaggaaattgcatctgctatgaattgtggagttggagctgtctagaccaggatggagggatataggcagagtgatgggtatacgcaaatccatggaggagaggggtgccaggaccctttacaccccaggagggcacatgggaaggagggtctggtggagaggaagctgaagagatggctggctgtgggtgtggagttcagactctctccaagtgcgtgtgtgttttgggccaggctgggaggggcaggcgtgacttgggccagctgtcctccaagtgagctccccatagtagcatctgcagcatggaggatcttgttacaaatgaaagttccggccaggtacagtggctcacacctgtaatcccaacactttgagagcccgaggcgggtggatcacctgaggtcaggagtttgagaccagcctggccaatgtggcgaaaccctgtctctactaaaaatacaaaaattagctgggcgtggtggcacgcacctgtaatcccagctactagggaggctgaggctggaaaatctcttgaatctgggaggcagacgttgctgggagctgagatcttgccactacactgcagcctgggcaacagagcaaggctccgtctcaaaagaaggaaagaaagaaaggaagaaaggaagaaagaaagaaggaaggaaggaaggaaggaaggaaagaaggaaggaaggaaggaaggaagaaagaaaagttcctaaccctggattaatgtcctggggctgacaaaacaaagtaccacaaactgggtggcttaaaatgacagctctggagactagaagtctgagaccaaggtgtcagcaggtctgcgctcactctgaagcctctagggaaggagccctccttgctcctctcagctcctggaaacccaggtgtccctgggcttgtggccacatcactccaagctctgtctctatcttcccatggccatctgcccccattatgtgtttacatttgtgtctctcttttctcttcttatgaggacctcagtcacactggattagggcccatcctgaatgtgcctgcctttgaacttagttacatctgcaaagaccctttttccaaataaggtcacatgcacagcactgggggttaggactgcaacatctccttttggggaaattattcaacttatcacaaactccgtccactgaatgagaacgctgggttttagcgagccctccaggttaagaagtgcttaacctggaggttaatgtgcctgtgtttttccaataaatgctcagagcctgaggcaattggagagcatgtctgtagtttgcaatatacagggttactcaaagtcaggcttgggaccagcaagagttggatccagagatgcatgatgttttagcagcaatgatattcatgaagctttttgcttcactccttgttatggtttgagatcccacagcagaccctgagacaaagacctggaggcaggtggttaacttgggaggtggggtcaggggaagggagatggggaagggagaggagacagggcaggtgcttcccgagactggtgctctgttgggagctggagcacagtctcgaaaggacaggtgtgaaacgtccaagagctgacctgccagcagctgcctcctgcccctcaccacagagggtggctgaagcttttatgccctggctctcccagctgccctgcacgggctgctgctcaggctaaggaccgagaagtgctgatgcttgagggactcatggtcagtgaggacaggctgtgagctgagctctgagctcggggcgaaccaaagatgggagaggagcatcagtgccccccgccccatcaccacattagaatcctgcgggaactggctgggttctcgaaggcgttgttatcgccctgtgctcacacataaggaccctgagacccagggccactagggtgaggcgacagggcagggcctgatgcacctgtcgaaatccacttctagctcccaccctgcccccagagacatgcgccccatgggccggcacacagcaaggggcttcggggcagggtgaaaaaatggcaaatacacacatttaagccaaaataatgaaatggccctggccctatcagcctcgaagctacatcaatgtcactttttttaaaaacgtaagaggggctgtgaggacatccagcccgtggtcactccaaacctgccaccacagacagttggggcctccccggagtccgtgggccgaatttcacaggcgagcattcccaggggtcctcaccagctgacttagtcagtttgggctgctctggcagccccacaggcaggggcaaaggcagaaatgtgtcttctcacagctccggaggttgcagtttcaagatcaaggtgtgggtaggcccggctcctctgagcctcactccctggcctgcagatgcccctctcctccctgctccgcgcacacagtcctccctttgtgagtgtctgcgtcctcatctcctcttctcgtaaggacatagtcctattgcattagggtttcagctagcccccagggtctcacttaccttactcactgctttaaaggacttttctcctactaaggtcaagttctgaggtgctgaggtgacaaggtcaacaaatgaattttggggacacaattcagccagtatcacttacatgttctgattttcctccccaaaattctacatgctactagttattactatgcccattttagaaattaatgagatactcaaagaagtgcagtaactacagcaaaatgccacagctcagatgtctccagcttcaaaatccagaagacccagacagctcctccagcacaggaagccaggacatcagctataacagctgtgtggttcctgcaggtggagtttggccttgcccaggtccttggaggcacgacttctgtgtctggtggaactgtgcagcgtggctcagacccacaagctgtgtgatggcttatcatccctgtgtaggcagggcatgctgagccaggctgactggacacctctgttcaggaagcattaccatcctaccagcaagagcaggtgaatagtttacatggtaattagccagcatgcactgttcccatgtgttcattcatttgttgaaaaacaaaataagacaaaacactccttcctggccctactagctccctggcttttctagaatatgctaagcacaggccacttcagaaactgtgagttcacctctccccctgcctggatactctttcttgtggtgttctcctcatagctcacacactcagcttctgcaggtacttgccccctcccccacattcccaggtcttacctccctcacctccccatcttccttcattgcactggtcaccttacagctctacaagagcagaggctcgcctgatgtgtgactaatccatccttagtacctagagcagtagctggagtatgcatctacgtggcaaaggtactacatgaacacatgggttcagagttcagcccattccacatgcatctgcaactcttcgtcaggccccagaatgcagcaggagtttgatacctgccatgggggcataaggagcagcaggcattgattgatggatgggctgccttactctggtttctgcaaataaaaataagaacaatccagtcaaggtagacaggaaaagccctgttaaatttctcctatcagcttgccactggaatcctgctgctgttgcagagacctggagacatggatggctttagaggccccagcaggcacaagacctggtgcacaggcccgagccaggctggagaatgactcagagggcagggaggatagaggaccaccagccatttgtcccgtgagttgcattagaccaggaaagccaagaaccacttcaactagttgaggaaagctgtgcctgttatgctatgtccttcagagagctttacatttttacgaagtccagaatagctgttggtcgtctcacagatacttacttaccctgctgcctcaacctccctccaccattcactgtcctgatgaaatcagatgatttgcgagcagagcaaccttgaggggaaatgacagcccctgagttcagtgtagagtctcaggctgggcacagaggccaggcagccccccgtgggcctggggtgggctgggcactgggaaggaattggcatttgctctgcacctgctctgtgacgaggcacacacagtttacatctagggtgccactgcattcttacattttattttaactttacattttattttaaagaaactcaggcttggacagtgaaagagacttccttgtctgtgggcacacagccagccagcagcagaactgagcttcttcctgctcccagaccagcccttccccactcccccacaatctagaagctgttctggaagccgctgactgcctcttgtccttgagcagacttcctgaggtctacaccacctctctggttcctggagcaaggaaggcaggtgtttgtgtcttctggccaaggattctcaggaaccaagagaagggatggtaactttgacacttctgttttcagaattgctccttgttcttcccaccgcattagagcatcgactgctgcttcctccagtgggacccatcctggtgctggcaggttgctccaagtgtgggcaccgacacatgctgggcaaaccagcccttgaaccaagaattccatttgctgagtctgagaggccaggttctctttggagtctcagttgtagcctgtaacatttgggctctcataggccatatttcccaccgctgtccttaaatagtactttagtcagatcagataacattaccatacgctctaactctcctgtaactactaaaccgaaacatttacaaatatgataaaacaagcctagaacaccagaatggttcaatttaacacagtgatgtaacacaacaacaaaaggacagttcctggctaacaccaagtctcagccttcagagcgccatggggctcacagtgtaggttcccccaattccgaattactgggaaactccatttgcccagcagggcactgggcccatgcggccttcatatgacaaggaagtatcatttaacctgaaggactgcttctgggtcctttttgtttttgtgtggtttttttttttttctttttttctttttttgacagagtcttgctctgtctcccaggcttgggtgcagtggtgagatctctgctcactgcaacctccgtctcctaggttcacgcaattctcctgcctcagcctcctgagtagctgggattacaagtgcctgccaccatgcccagctaatttttgtatttttaatagagacgggtttcaccattttggccaggctggttgtgaactgctgacctcaaatgaccctctcacctcagcctcccaaagtgtgggggttacaggcgtaagccactgcacttagccatggttttatctgccacaaagaaaacggttctattgggccctctaaatggaagcatgggctccgagaagtcccagccattctgagttgcgtagcgggcctcccagtcccataggcctgacccctacctctttttctttattgccacccaaaaatgtcccatacataacataactgcagaaagctgattatcccaaaggagtcatctgaaaacctgagttctgtaaaacactgatctagactttt

SEQ ID NO: 17696 - DNA, 16640 bp, Homo sapiens
ggagttcagtggtgcaacctcagctcactgcaacctccgcctcccaggttcaagcaattctgtctctgcctcccgagtagctagaattacaggcacgcaccaccacgcccagctgatttttgtatttttatttatttatttatttattttttagtagagacgggatttcacgatgttggccaggctggtctcaaactcctgacctcaggtgatccacccacctcggccttggcctcccaaagtgctgggattacaggcgtgagccaccacacctggccaaccttgactatttattataggtaattctgtgcagatgtctgacttatgttggccatctccaggatggacctgaactttcacacgtatgtccctatgactaaatccaggtgtcatttgcaaaaaacaactaatattattaagtagctaccagggctaggtatcactcaccatacatacacacatgcacacacacacatacacattcctacctcatccttacaacaatcttcattttacagatgaggaaacagaggcacagacaggtcgaataacttactcaaagtttcacagctagtacattcgaacccaggcttaaggacccatctttgtccagaccctgtatgcaagtgtctgtgacactggatgccaagactcacactagagatgttgaatttaggtctgaacaatatccaattctgtgtgtgtgtttgtgtgtgcatgtgtgtgtgtgttgtattcatgtcttaaccatccatattcatatacacatatgaacatctgtgctgtgattcttttttttttttttttttttttttgagatggagtttcactcttgtcacccaggctggagtgcaatggagcaacctccgctcactgcaatctccgcctcccgggttcaagcgattttcctgcctcagcctccagagtagctgggattacaggcacccgccaccatgcccagctaattttttgtatttttgttagagacagggtttccccatattggccaggctggtctcgaactcctgacctcaggtgatccacccgcctcggcctcccaaagtgctgggattacaggcatgagccaccgtgcccagcctgtgctgtgattcttgaagctgcaacccatgtgcatgcaagtgaatttcagcttccagtcctgtccatagctgtacctaagtgtggaagctggatgtgcatgtatgcatgtccatgaccttgtatagccacatctgggactcatactgcacactgaatttggctgacatgtccagactctggggccaaggctgggtcacacatactgagtggccacatgcgtttgacgtctgtgacaatttggtgaccgtgaatgactggtttcaagtgaccacctgtctgaacctgtatccagtgcccctgtctccacccccaaccacagaggacttcttgccctctggtctgttccccttcctctctctcccagagtcttatagcaaatggggtgggggctagagttctggagaaaacaggcagcggttgtaaataaacaacagggcaggcggagcatggtggctcacacctgtaatcccagcactttgggaggctgaggcgggcagagcatttgaagtcagaagtttgagactaccctggctaacatggtgagacctcgtctctactaaaaatacaaaaattagccaggtgtggtggcgggcacctcagctactcgggaggctgaggcaggaggatcacttgaacccaggaggcggaagttgcagtgagctgagatcatgccactgcactccagcctgggcaaaagagtgagactccgtctcaaaaacaacaacaacaacaaaacaaaaaacagggcagggtgtcttgagaagttaggggaaaggcataggcatatagtagttagggcagggtgcaaggaaggtgtaggaggcaatgtaaacgtccctgtcctcaggcatcctctaccccttctcttagcagcccaggatggtgacaagttgctggaaggtgacgagtgtgcaccccactcccagccatggcaagtggctctctacgagcgtggacgctttaactgtggcgcttccctcatctccccacactgggtgctgtctgcggcmcactgccaaagccggtatgaaggcaggggctcagggtcctgagggagcctggttcggggggaagagctcctagatttgggggaagacggaggcagacgccagaactcctgggttctgaaagacgaggaggccggatgtcaagcccctgggttaggaaggagtgtgtgtttcaaagccttcgatctctgaaggaggaaggagaagactagttccagcttttgagcctcagttctagggatgtgagaatcctggattcggggacagaccaggagggggctgggagtagttggaggggatcgagttctaggagtgtgcctgacttcagactcgttggtccttgaggagcaggggctggaaccattggcttcagggtcttgggaaaaggtaatgggatgtcgagatttctaaagggtcgggagacctcgggttgcccactctttgatctttctgtcctctacttgcgggtaaccactggcccgcactccactggcgggaaaaccactcgcccgcacagcttcatgagagtgcgcctgggagagcacaacctgcgcaagcgcgatggcccagagcaactacggaccacgtctcgggtcattccacacccgcgctacgaagcgcgcagccaccgcaacgacatcatgttgctgcgcctagtccagcccgcacgcctgaacccccaggtgcgccccgcggtgctacccacgcgttgcccccacccgggggaggcctgtgtggtgtctggctggggcctggtgtcccacaacgagcctgggaccgctgggagcccccggtcacaaggtgcgtgaaaggatggagctggatgcgaggcctcaaggaatcctatgctccagggctcttgggcggaggggacaagggccggaatttatggatctgctccaagtccactgtcttccccagtgagtctcccagatacgttgcattgtgccaacatcagcattatctcggacacatcttgtgacaagagctacccagggcgcctgacaaacaccatggtgtgtgcaggcgcggagggcagaggcgcagaatcctgtgaggtcagagcctagaggggccatcaggcggaagaagagggatggggacaggtgtgggagtccggatggggttggattttctttgctttgggccagagaagatgctagggttaggcttggagatggagtaggaagagaagttagaataggggtgaggttggagttggggttataggtggggattgcgttgtttgaggtggataatgtgatagttagtttgagatggcatgggttggggttgagaatgggaatggtttggtttgattctgggtgggaaatacgtcagggttgaattgggatgaggtagattttgtttggaatgcagaagacatgaagattgagattggattttgagatgggcatgggtttgatttgattttgaatggtgaggatgtgggctgagttggatttaacttagtacagttgcactggagttgcatgggggtgagattggatataggttgggtgagttgtattgagctgtgttgaattggggttggggttggggttgggttggctctgtttgggataaactgggctgtattgagttgagttgggttggggttccctgggatggggatggattgggtttggggtgagattgcaaatggtgattaggatgaggatgaatccaggaggtttcactcaacctgagaccccctcttttccccacagggtgactctgggggacccctggtctgtgggggcatcctgcagggcattgtgtcctggggtgacgtcccttgtgacaacaccaccaagcctggtgtctataccaaagtctgccactacttggagtggatcagggaaaccatgaagaggaactgactattctagcctatctcctgtgcccctgactgagcagaagcccccacagctggccagcagccccgcctgacatggaacagaacggagccatcccccaagaccctgtccaaggcccagatgttagccaaggacttgtcccacctgaggacaaagctggcgctcaaggtcacctgtttaatgccaagataacaaagcgctgatccaagttgctctgtaggaatttctgtgacttttttctggggtcaaagagaaaccccgagacactgtacactgttccttttcacccaccaccccgatccctaggtgaggagaagcggcttgaagcagggctccattcattcaacacacatgaccacccgtgtgatcttgaacaagaggcccaatctcacttcgccttggtttccttatctgtaaaatgagaccatcttattgctgacttcaaagggctgttgtgaggattaaatgagatgattcgtctgaactgattaaaatcgtgtctggcactgagtaaataccctctatctctggatcccagttaaaggacctaacagacactagattaccaagaatggctttttctttaaggtttagttctgggccgggcatggtggctcacacctgtaatcccagcactttgggaggccaaggcgggcggctcacttgaggtcaggagtgcaagaccagcctggccaacatggtgaaaccccatctctactaaaaatactaaaaaaatttagccgggcgtggtggcacacgactgtaatcctagctacttgggagggtgatgtgggaggatcgcttgaacttaggaggcaggagttgcagtgagccgagatcgcgccactgcactccagcctggtgacagagcaagactccatctcagaaaaaaaaaaaaaaaaaaaaagatttagttctgggcttcctggtagccatggcaaaaaggcaaatactgtcctttccttagccaggtccctgatatacagcagaggctggaactctgagctgctttgattttaccaaaaagccaagacaacctgttggaagcctatgggtttaccattgaggctgcaggaatctagttcctaattatcttcagagaccacaaaatgtgatgttcaaggtcgctgaatgttgaagtacatgaacctggctcgtgagacctaaatattgtactggtggtgggggggaagggtcattggaatctgtggttagcctgatcttgacctgggagggaaggttgtccagatctctgggactttggaggacaggacgttgagcacccataactgggagcaagaagtgggaggctcattgagaccccagcattgtttgggagggacactggattttgtaatgctaaagaacttaccctgggagacccctgaaacttcacattcctggatctggaggcactaggaatgtggtgatgtgtaccccaaaattttattatgaaaggaacagtagctttggggacctaggtcctgggtctgggagtgcaagaaccagggcattctgaaggccaaggcttatatttcagggggaactggcagctgagatgctagtatcttggctccgagtggtgcagggaatcagagccctaactgctggtgtttgagggcaccaggtctgggggtgcagggccttaattgagactgaggtatatggggctttgtaccaggggtcactgattcctccgtcttcctgtttctgcttcccctcagtccccccttgcctcactggctgctccccagagcaaagccccagagccacaggccctgccccacctggcttcaaccccaggaatgcgtccagcgtgatccagggcctgcagaacaggtgctggttctccctccccgtctacagctctggggatcggaggsgggggggcaattgtccagcccccaggcaacaggggaagggccttggccaacatctgggtgccagcagggcaggggtggggctctgaggggataagggcttttaaaagcctccccagggaggttccccagttcctccacctgctggcccctggacacctctgtcaccatgtggttcctggttctgtgcctcgccctgtccctgggggggactggtgagacagtggggggatgtgggagggggaacgggccctgattctcttgctggcctcacatccccccccgataagaccttcccctccaacaccccaccctcatccctctggcccacagtctatcctagtccggggtgccccggctcttatctatcttgcgcggscccaccctaaacttccacccccgctcctccatgttgtcatagtgctcactcccacaccagattcctgctcctcccaggaagcctcagtactttctcctcttccctagccaacgccctgtcccaccgctttaccaaaggggcagattctgggccatctctgtctctctctggaggaccccaaccctcccatgggcttcccccaccccacaggactctgatcatcccctcctgccccctagttccctgcggccacctatttggctcctgagtctacaaatcccaccacactccagtgactttttccatccagctgtccgctctcaactgtgtcctccagaccctgacatctggtctccccagtccttccagggtcccccaaatttcaccagaaaaccctgcttcccaaactggcatgtgggatcccccayctggtatgggggggggtctgcaaatgtcccttcccacccagcacccccagctctcccaggaaaaacaccamaccctcccaccacatgctcctttccttggggaagttccatcccgccccaggccccagcccttctctgcctgaattgttcctacacagctctggttttctggaaccccacsccaaggatcctgaatgccttctcagccagcgcttctgccctggcctcccccaagtcagtatgtgattctacaacctcacrtcaagtgggtcctgcattgcattcccacagctgcttggcgcctgttctcaccacttctccaatcctcttcctaggattgcctccaagaggaccccatatccttccagtaccctcagaccatgaaccccatccccatgagaaacgaagatcccatccttcaccctgtccgagaaggactgccactcacgcctccctcctcctgagccccgtcccagtcctgaccgcaactgtgttctcagggccccaacctcccctcakattgccattcctggttcacaggaaggaccccaaaacctctcggaagcccacctctagccttaaccatagccctttcttttaccctttaaccaggaagccctgaaatctaactgtcccagccaagctggccccttccaaccccaatgtagggaccccaagtcacccccaaactcttcagtcsagatgctcttctttacctctcagacctggttccctaaagctgcatcctttcctgaacctcaaaagcccaacccaggtcctgtttccctagcctaggagccccttagccctccagattcttcctcagtgagcctctgatcctgtcccacccttggcgccttgatccctggtttccagaatccytttccactcccctaacccaccacctcccatcccccagccccagaccccaaatgacctgacgcccagatgcagtgtctgctccagacactgtctcctgtctcctaccctgatccctggaggctgctctactgtcagagcacaaaatctccccaccaggtccagccaccactccaaaagcccagggaacagtccagagtcccaccccttcccaacaccccttgcccatgtccccaacctccagccctggtcctctacccgcaatgtcccttcagacccacagcccagctccctctcctagccttgtccctggcctctcctgccaaccctgcccttcctgacccagcaccgcctctgcaggtgctgcgcccccgattcagtcccggattgtgggaggctgggagtgtgagcagcattcccagccctggcaggcggctctgtaccatttcagcactttccagtgtgggggcatcctggtgcaccgccagtgggtgctcacagctgctcattgcatcagcgagtgagtaggggcctggggtctgggaggagggcatctatgctgccacaggattgacaggccagtggcattccccttggataacctcaggcaagactggggggctgagscagagaggaaggctctggcgcaggtcgcctggcagggcagagctgggctggacacccctctccaaggctgcctgggtctcttgggatctggttctgcttgtgtctctgtgtgactgtgttctggtctctgtcttcctctctctcctctgtctccttgtctctgcatctcccctgtctctgtctgtctctgagtctctctgcggcatctctgtcactgtgtctcaccctccatctctctacccatctctctctctctgggtctctacctcaccgctccctcatccctactaaacacacacccagatggacctaagggaggccccagagtaaaggaagggctttatccccaacttgtgtgcctgggagggggcgcctctccctctgtccagctccccgccccacaggatatccctccactctggagagacacagggaagggctggtttcagcgggagctgggtggggcaactgagggaggaggaaggaggaggcggggcgagaaacgcgcgggagggtgctgggaagggaagggggcctcgaccttggacttcaggccaggccacctgcccctggggagcccgcaccacagccccagctgcagctgagccgctctcaggcctcccctcctccctacctgcccccaccctccccacctgcccccaccctcccccagggcctccctcccttttctctcccacactcggtcactcctgcttcctctctgcctctgtttctagttctcactctgacgtcccgcgtcctttttcatttgtctgcttctcgctcccttccgtgttctgttccctcttcctccctcttccctgggcctgtttctcgctgtccctgtcttttatccttctcatctgcctcttttttgctcaccctgtttctcactgccctcccctccgcctttytcacccctctgtccttttgagctcttttttgctctgtctcttcatttgccttttgcactctcaaamtctttcatcttcccattcgctgtctgtatttctccataactatatctttcttcctctgtctccgcccacccacatttttctctttccctttctctctttggggaccctcccccatgctcccctgccccatccccttttccccttcccrtcttctcatccctccattcccatctttccccagcaattaccagctctggctgggtcrccacaacttgtttgacgacgaaaacacagcccagtttgttcatgtcagtgagagcttcccacaccctggcttcaacatgagcctcctggagaaccacacccgccaagcagacgaggactacagccacgacctcatgctgctccgcctgacagagcctgctgataccatcacagaygctgtgaaggtcgtggagttgcccaccsaggaacccgaagtggggagcacctgtttggcttccggctggggcagcatcgaaccagagaattgtatgtgggggcagactgtgtagcccaaggcggggatggggactcctgygtccaagggagaaagggccagggaagcaggtgaggtcgggctgcagccctttttctcccgggttcgtagtctcatttccagatgatctccagtgtgtggacctcaaaatcctgcctaatgatgagtgcraaaaagcccacgtccagaaggwgacagacttcatgctgtgtgtcggacacctggaaggtggcaaagacacctgtgtggtgaggcagccctgcccccagggtctggaagggctgagggaggggactcagcctctgaactggcttctgagagctaaccaggcatctgcttcactgcttcccagctagctgtagccactcgccccatcagtgccccagctccccctccttcccccgcccatccagggacaactgcatctcaccccccacaccagagttcaccgttcctcgtggtaatgtgttgttaccgtcgagtcagagagtagtcctggagaggtggcctctgcgatgtgcccrcaggggcagcgtcctgcagatggtcctgcccctcctccccctracctgtctgcaggcactgtccwcctggaccctgccccatgtgcygmagctggaccctgaggtcccttcccccttggccaggactggagaccctgtcccctctgtgggaatccctgcccaccttcctctgggagtgggcactggaggccctgtctgcgagctggggctccccaggcagaacttgggccccgtagacctttctcactctcccctcccaccttgtgctcccagggtgattcagggggcccgctgatgtgtgatggtgtgctccaaggtgtcacatcatggggctacgtcccttgtggcacccccaataagccttctgtcgccgtcagagtgctgtcttatgtgaagtggatcgaggacaccatagcggagaactcctgaacgcccagccctgtcccctacccccagtaaaatcaaatgtgcatccaatgtgtgtcacgttctgccatcacctatctttccagatgtggtgcacctggacccactcggctgaggctggggccaccccagctgtgtcaatctcatgcctggaagtctgaggtcaccagcaggtggggaaaggaaggggctgtgacaggtgcagacaaacaggcagggaaaggctcagatcccaaagggcgagtcagggacgccagaacagttcactcacactaggatggaccctgccctggtggggaggtggggggcaatggaaggtctgaggctgagaggttttattgtggcggggaagccagaaaaggtacagagggatgttattgcaagccatgccttcccagggaggggcccgttctgcagaagggtggagttgcaccaaatgctgggcggtgctgtgtccacctggggacaagggtggacatcggagctgaggccggaactccgggacaagggtggacatcggagcaccctggctgagcgggtggagagtggcttcagggtgtggcctgcgaaggctgggcaccaggggcagggccacacaaactagccacactgccgagctcagcgggacgctggacaagtgtctgcagaacgggaggggatgctgggcctctggggtggaggcactgtgaggacccagtgggcagggacaaagccgcaaagggcgggccctagagcgagggctggagtttgccaccggtcccctcggagggcgtggcctgatatcagggggtggggcctcaggggaggtcgaatatccagggcgtggccacgctgaaggggttggccgggcatctggccatggctaccggtcggtgtcctgaagacctcgggtgctattccttggaggtgcttgggtctcatcctcgagggtgtatgaaatgggaaggcccggggtgcgctcggagtcagcgtctgagttccgctgtttggatgtccgcctcgctgcgccctgctgcacggcccacccgcggtagctcagccgccgcgcattcaagggctgccctctgcttcacatgcccactgggcttaggtaggacacggctcctgggagatggctaggtgggccgctgtactccgagtcccaccctaggccccacccgcttcccgaggccccgccctcctcccgaggccccgccctcaccggagtgcagcatcaagtcgctggcgtcccagcacaggtaggaggtcaccaggtaggacaccaccggacttgggtgcaccgccttgccgttaactgaaaagagcgtcaggctgaagagaaatcaggagccctgcaatggggtggggccagagacagaaggctggacagtgagccctatgacccccagtaagaaaagagggactgagacatcctctcccaccctccgtgacaagcagacacacacacacacacacacacacacacacacacacgccctcacaacagacagaaagatacctggagagaggggacaaaaaaagaaagggaaacagagagtgggggagagagacatcccacagatagagtagaactgagtcagagctccccagagacatgctaagacagaggccccgaggggagcagcacggaagtctagatacacctccagaaagccagagagcagggctggggttagggagggcccccrccccccaagccaacacctaccaatgccgaggcagaggaaactgaagacaaagtcggccatgttcaggcggaggaccactggccaggaggagagggccatgggcgggaggaggactcagcacagggccacggccagtaacatgaagcccttgctcatatggatgagaactggggagagggggacaggggccccagagtcamccccagatacccctcttggtcaccctccaaagtcatctctgctgatacccacaagcagcccaacagacaaccccaaagtctggcacatcctcaaaatcacccctactcacctccccaaagtcacctcctagaaaccccaaagaaactccaatctcactcacaaggtcacccccagggacccctaaagtcatcccccagtcacacccttagagttgtcccaaatcacccctacttaacctaaaactcaattctcagacactctcataatcccacacaccccccaaggtcaccccacagaggaccccccaaaggtcatcccactcatcctcaaggttaccccacagaatcacctcaatcatttctttctttcttcttctttttttttttttttttttaagatggagtcttgctctgttgcccaggctggagtgcagtggtgtgatctcggctcactccaacctctgcctttgggctcaagcaattctcctgcctcagcctcccgattagctgatactacacgcagctgctgccacgccagcctaatttttgtatttttagtagagacatggtttcaccatgttggccaggctggtctcaaactcctgacctcaggtgatcggcttcccaaagtgctgggattacaagcgtsagccactgagcccagcctcgatcatttctagaaccacccccacagacacccctggtcaccctacttgaactcctaaaaggtgtctcataacaactcatgttagtatcctcagtttcactcccagacaccctcaacagcaccctcaaagttatccaagacaccacggtcaccccagtcctctccaaagtcaccctacttctgctctagtctctgctagtcaccccccaaggtcccctagtggccccattcacatgccgagaatctcctcagacatcctaatgtcatctcttgttcacacctgagagcccccacaaaacacatacagatttgcacacaagaaaaactttcaagtcaaatactctaaaaccaatgtgcccaaaagcttagttccagtttacagtggatatttatccaacttagacttccagcagaagagaggtttacctgtttccgagatgctacatctcctccttttagccctttttctactttgtctacttttcaacagtgcaaaattgttttagccaaataggccaagacctcatctgctttgtttctggcaaactgcacatctctaatacccaacaagaaagataaaggatcatcatatatacagaagagcaacagcactctgggaagtgggggaaatatcagaccccttggttttttgtttttgttttgttttgttcatagagatggggtctcactgttacccaggctggtctcagattactgagctcaagcaatcctccctccttggcctctcaaagtgctgggattacacgtgtgagccaccatgcccagccagttcccttagttctttctgctcattgaagagtcaagaagcagaggtcagggagaaggcaccaagccagaaaccaagaccttgaatggtgaatttggtctgcccagaacagcagcctgacatctcttggggacaccctccacccaactcacataaccctggatgagggattctcctggcatatgctggcctctgggccacagaggtaatcatgtgattctggctgagccaatcacagtacccyagctgcagaccctgcaattggcccaaagatggacacatgaccaaagcccaaccaatcaagctctgccccaagactttttattaggaagctgtcaaggaaaagcagtctctcctcaaggattacaagcctgaagctgcctaagccttggacctagcttcatggggagagtaaaactaagaaggaaaacagacaagcgaaagagcattgagctgacactgaagtccctggctctcgtcatcccagagagcagcccactctgtgatttggtcagaatgagtggatatttgcagcttacctccccaccatgcatttcacctcctgcccattccccattctcagccccagtcttaagccaatcagccaactgtactccactggccatataattggctcggggtgctcatgtgccccaagccacacaggattcttgcaagaactgttgataacttttttctaccggactcggcagttattaccaactctgccaagttgctaacaactctgccagttttttgtctgtctgctctcagatccatttcccgccctgtcctgttctgcactgcaaggaccacatttcccagcctcctttgctcaccatcttatcactgtgtttgactaatgggaggcactggcagaagactggttctgggaggagagggcaagccagggtatttattagcctctctatctctgcatgtggtgggtcttccgtagtagttgtatctattctctgattctagccacttctgagcaatccaaccatgaacctatgcgttccagagggctgcagtttctggactgtagtaataccacctcctccctttgtccttctggccaagtagcagcatcctgtagttcctaactcctggtttgcctcactatttcctattggcttctcagctcctctgttactcacgaacaaattccctgtatttacttccttctgaagaatctggaatgatttattttccttactggattctgacttgccactacacagagccttgagaatgaagccaatcccatagccaaaaaacagtaatatctgatactatcacttgggcccctggatccacccatgcctgaaggcattcctaccattaccatttttcactcaggtgatcccataaaggatcccctagctagttcaagttagttcactcaagctaatacaactagttcactcaagctagttcaagttagagtttgtgtcacttgtggctgggcacgatggctcacacctgtaatcccagcactttgggaggccgaggcaggtggatcacctgaggtcaggagtttgagaccagcctggccaacatggtgaaactccgtctctactaaaaagataaaagttagccgggcatggcagcgggcgcctgtaatcccagctactccggaggctgaggcaggagaatcgctcaaacccggggggtgaaggttgcagtgaaccaagatcacgccactgcactccagcctgggtgaaagagtgaaactccatctcaaatttaaaaaagtaaaaaataaaaaaaatttaaaaaaaaagagtttgtgtcacttgtgacccaaaaactcctgactaattcaagtcccttccttaggacagcagggagcacagaattcaatgttccctgcataccaactccaaaatcacaatcaaaacctaaaaataagtaatgagaatttaaaaaaacagaactgaatgttcatcaaaaatctggagggagaacctcccgaagccaagaagcaattaataaagtcacagagacaaaggtgaagaaattaaactacctaaaaattctaaggctgggcacagtggctcatgcctgtaatcccagctctttgggaggctggggtgggcagattgcttgagcttacaagttcgagaccagcctgggaaacatggcaaaactctacctctaccaaaaaatacaaaattatagctaggaatagtagcactcccctgtagtcccaactacgtgggaggcagaggtgagaggatggcttgaacctgggaggcggaggttgcagtgagccgagatctcatgccactgcactccagcctgggtgatagagccagactttgtctcagaaaaaaaaaaaaaaattctagatttctataccttaaaaaataataataagggccaggcgcagtggcttatgcctgtaatcccagaactttgggaggctgaggcaggtggatcacctgaggttaagagttcgagacccgcctgaccaacatggtgaaaccccatctgtgctaaaattacaaaaaaattagccaggcacggtggtgccaattacctacaattcccgggtcagtatccaagaccctccaccagccaggaacagtcacggggtcagtatccaacagcctccaccagccagcagcaatcgcctggtcagtatccaagaccccttgccaattattcacaatcaccaggtcagtatccaagaccctacaccag

SEQ ID NO: 17697 - DNA, 103012 bp, Homo sapiens
  misc_feature (1)...(103012): n = A,T,C or G, or insertion/deletion polymorphism (see Tables 1-2)
cccacacccagcaactttttgtatttttagcagagacagagtttcaccatgttggctaggctggtcttgaactcctgacctcaggtgaggtccacccatctcggcctcccaatcctgcctgttttgatgagaaaagtttttaagaaaagtcaaggaaaatcaagaatagctacacttttaccacagcagaagaaatcatggaattacagtgggaattagtgtaatggcttgactgatctgctagtccaggacttatttcagaaatgtgtcttcttcaaacagattgtattagtgcaccaggcaggacttctttggttgtaagtgttgggaacttaacttgaactagtatagaaaggatgtctgaaatcagagagctgattgcattctctttctctcctctccacttctctctgctttgatctccctgactggcttcctccaaatggtagcaaatatggcagctcctggtattatcagagagggctcaagactggctggctctaagatgtaagcaggcagacctggggatgagcttaccaactctggatcacctggtagaggagatgctagaaggttcttctggaagatggcagctctcatttgaacccctggtcaaagtaggggatgggcattcctgaaataagagaagtgttggtctagacacatgacccaacagctttctgtgcatggctggcactacgttttccttcatagcctggtgtgttttagtagcataaagtgaagtgctatttggttttagactctcgaaaatcgcagaaacagcatcatttgtgcagtagaatagagtaggaaaaattcacaccaacatgtccatatgaagtgtttagggaatggggaggggcagctggtccatctttgttcctgagcccgggtctcagtgggactgaatctagaggtgggagctttgaaatgtgcaaattggggcagggatagaagttgaggctagaaatgaggcagagacgaatatggctgatgcagcccagatccctgaggggttattgctggatgattctggacattattgagcacagctaccactcactctgcagaagagaaaacagagttgcaggaagcttagttgacgtgcccaaaacctgtggtgagttagtagcaaagaaggcactagggcctcattcccagagatccgctcaactttccactctgacactcgaggaggcttaaaacaggcacagggatggaatgagaaaccccagctgccctctggctgtggggtcagtggaagcctcaagtcctcttccttgattgggcttctaatccttcttgtcttgaaacaggcctagttgcctcagtggagcattttactttaagctgattttggaatgtcacatacctcctcttcaataagaggaaactccagcctcactgcaacaagcaaatctattaacatgattgcagatccatcactgggagctggttgggagggtgagaagagtggacttgagctggccctccaggaatatctcccaggatatcccagcataaaccctctggtctattctgggaggcagggaaacaggagcctgccccggagagactgaacttaggaacacactgcacagccgcaatccagggtttacaggacaaagatcgaggcacccttcagcagctgtctggatgctgggatgcggggtgtggcagatgctgctgctgtggctgcgacttccctttgagtcctggagactgtgatggaactcggatgcttagtctgttacacagtctgccactgcctcttaacattcagggagctggagtcttcatattggcttctctatgactgtgtgtatgttcaagttccttctagcagagcctgagacagggtgttgtgcaagcgattactgagggagagctcccaggggaaacctagaaggaaggcaggaagaaggatgagggcaggagaagaagccaggcaaggagtgggttctgagaagtcaggctggtcccatggcaggtgttctgcagtgagaatcctcttgccaagtttttctggcccagaggcaatggactggagtgtcacatcccacatcagacatcactggctgtgggccaccccaagggagatgggctataaccctgtactagttatcaactgctgtgtaacaaattgtcacaaaactagcaatttacgacaacatgcatttagtatcttgggtcaggagttcaggcttggcttcactgggtcctctgctggggtctcagaggctgaaacctccgtttgggagactacatttctttctgaaacacggagtcttttcaaagctcacgtagatgttggcagaagtcaggcccttgtggttgtcgagttggggttcctgcttccttgcttgttaggagctgctctcagctcccagaggcccccacatttccttgccattggccctcacaggatggcggctcactttgtcaaggccagtgtcttagtccatttggatggttgtaacaaaatgtcttaaacttggtggcttaaacaacaaaaattgatttctcatgtttgggagtttgagaagcccaagatcaaagtgcccgcagattcggtgtctggagaggtcctgcttcctaactcgtgcactgcaccttccctctgtatcctcacatggtgggaggatggagcagtctctccatatcctcttttataaggcactgatcccattcatcaaggcttctcctctacgacccaataacctcccaaaggccccatctcccaataccatcactttgggggttagaatttcaacatatggatttttgggggacatgacatccagaccccagcagccagcaagataatctctccctgccgtttcctaagacagagtcttctgtgatccctgggtgacttcccacgacccaactgtaacctaatccaggaagggacaccattcatttttgtcgtgttcaaaggctggaatcagggctcagcttccatttgcacgcaaggggggtggattacgcaagggcttgactcctgggggtcatcttggaattccacccacctcacacaccccaatgtgtccagaagagacagatcccagcatccacgaacagtcctccaggaaagggcgtgggtgtgaaccactaacatttgactctcatctgaggggagtcttgcagaggcacccatgggaccttccacactgtccttgcccgcaggagaaagggcagccaaagtctcagaaaatcgccatccctcaggccaccttccaatcccatagccgtgtatctggatggggaggccccatccccatcagggccacagctacaagggagcttggaaaatggagttctgaacttgctaacttgtgtagttaaggacaagataagggaagaaaatgggaagaggtgccaagagccagttcaagcctgcagtgaaggggaaacagaattgagatattccgtgacttatgaggtgaactgagagattcagtgacttatgaggtcccaccgatggccgggcctagatccaggactcaggacgtttagggcagctcaaacttttgaggttgttttcctcctgggatcaggtagcagagaggaactggaaatgtaagtgggaatccacatagtggtgattaaggaagaaagctgccatagaacccaaattctctcttgttagcacaagggaggtttaccatgagtttctggaagtttctagagccatgggcagtgctgaagaggatctggatcatcaatgagtaggtgcagctaaatattaaagattatggtttcctactgaatgggagcttttatttctttaaatcatgttctaaatgatttcttgcccttgctgtttaaatatagccatccattggtatccatgggggactgattccaggaacctccatggatacccaaatccacagaggccccaatccctgaaggaaggtggtgtagtatttgcacataacctatgcacatccttctgtgtacttcaagccatctctagattacttataatacctaatacagtgtaaatgccatgtaaacagttgttatactgtgtcatttagagaatgatgacaaggaaaaacatctgtacatgttcagtatatatgcaatcatctactttaaaaagcatttttgaaccacagttggttaaatccatggatgcagaacccatggatacgaggtcgactgtaatagaaactttcaataccaaggaatgcatctgcctagcgattttgcgaaaaagagtgtatttgtatttgaaagaaaccgtggagtggaaacacctaaaacgtgcttgttcagttaacctcagtttgctgagctgcttggagcatggggttgtaatcaaaggttgtcttcttcgcagcagacaatgttctgggagaaatagtcctccttagtgctgaagttgcagactctaaccaagggggtggcagcaagtatccccggtctctgtaggggcttgagtcaacgcctgcactgtgcagagaggatgagggcagagaattggatgccgctggaggggcgtgttgtccttctacatgtcatgcaggcagcgcggttctatactcggagcctctgctcagcgtgtcttcacctaagaaccccataattcaggttccatccttgttccctactccagtgctctgcaagtgagccctttggtttagagatgggttgggcttctttatgggagaggaagggagccctggagctgcagaggggagcaggcattctctctggggtgctgtctcctttcttccctaaattggagggagataatccatggaaaggagttaatgatttctttgctcttcaaacttggtttggaaggatctctcagtcaaaaagaacctttcggatgtctcttgatatttcacattaatggacttttcataaggaccacatgatgggagagcagtgagaagtttggggatggccaaagctgggttgtcatttgagctctgttactaacccagactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaacctctgcctcctgggttcaagcaattgtcctgcctcagcctcccaaatagctgggactacaagcgcctgccaccatgcctggctaatttttatatttttagtagagatttagtaggggtttcaccatgttggccaggctggtctccaactcctgaccttgtgatctgcctgccttagcctcccgaagtgctgagattacaggcataagccaccgtgcccagcctgtttctttcatctgtaaaatgggaccacaatttcacctaataaaagaagacatctttctatttaaaagggcttagggtgttgatgtttgtgataaaggagagaatgtatattgaagtgttttgaaatgtgcaaagctttctagaaacagaagttcttactcaagtattttcccgaagctttggcaagataaccatttttattaccccgtctgtgcctagaatgggcctataagcgccacaatcagaatcattagatatagaaattaagagaaatgtagcctccttttttttgccggtgaacagagctttggttaacagaaaaccaaggcgattttaattgctggtttttctatttgaagggggaagttattagtagaagtctcaattcagaaacttcaagaagaaatgggagggtgtggtgagggtaagcgggggactgcatttcctgttttcctttcagatggtgttggaaaacattgcaggaaaaccatggatacccacgaagaaattccaaaatttattctttttgacgccaagggcccagcccaaaaggtgacgagtaggagtggtcaatttttttttttaagagttggggcttgcaggagtccagctaaacgcttgtagggtgaagacagaattcagagggtgacatcagcctgagcgggggccagaagaaacagagtggaggagtctggtttcatttacagttttgggtcagttctgcagtgaggagggggagaggaggggtcggggagggaggaggaggaggaggaggagctggaggaagccctgactggtatccctggccccagtccagtttggagctcagtcttccaccaaaggccgttcagttctcctgggctccagcctcctgcaaggactgcaagagttttcctccgcagctctgagtctccacttttttggtggagaaaggctgcaaaaagaaaaagagacgcagtgagtgggaaaagtatgcatcctattcaaacctaattgaatcgaggagcccagggacacacgccttcaggtttgctcaggggtaagtgtgatttctcttctgtttttccaggtttggggctagaaggaaatgctcttaacctgaagtgatcctttctaggtagcgttagtggctcttacgttcatgctgatcgccagttttctgtacatgttttaggtctctggaagattccgctgatttttctttctcactttatggcaatgggatttccttaaattggttaaggtcatgattgcctaagagtgtgagcacttttccaccgcgtgtctgtggctgctacacgcgccctgtgcattccgggcggcagtgtgtttcggcccatgatttatttaagttactgccgccttctaaaacccattcgggatccgctttgtttgcagaagcgtctttgctgaggactagcatagctccctgccgggcggctccgctgggagatgttctctgagctctctgggtggtgacactaggtcagggtgcaacaacctgcatgggttttctgcccagggccgcccatgggaaggtcctggtggagcacatttgctgctttcacaagattggagtaactctggtgctcaggatcagggccaagtaaagggtcgctcagtcattgccgtcaagctttcgtctttccaggaacctgaagtctctattggagactttgtcccttggggttgcttaaaggagttgcaggggtcagaggagaagaaggaattgggcatttgggcagcatgctgagtgtctaaggcagggcccctggggctgcagggccagcccatgctgcacagaggtgaggccagtgccgagctgggaggccccgagggctgttctctggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatgctcaacctgggatcccccagctccccagggtcccattcttaatgctgtaaaaaacaaccgaaatggctttaaaatcgaagttacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagcgagtgcctgagatggcagtgaaatccttccccattgaaggagagcagacaagccagtgacggaggatcccaaataactcacatctcgttgggaaaactgctttgggctcactaagactctaccaatgaaccgagaaagaagggaggtggaccgtggggcgggggcatcggttccgtgaccggaataccggggctggccgccctgctcaggccacctcctgggggtggagggcgctgaaggaggggacctgtatgctcttctttctgaagtgggcttgtagctgaggatgaaagcctgggtggggaggcgtggcttttacaaagatcaggatctaggaacagctgcctgtctggacttctttgtttagggggtttcttgctacccagaggtttagttctctcctttcctcactcatggtcgagagaagccaggaagcagacactgagtggagcagagggcttgggaaggaattccatgttggggtgaagtgaggctgtcctggcttttcctatccaggcattggagggtgtggctacagcacctttctgggaggtggctggggaagcctctagaatgttagcccttggccccgctctttccctgcttggcagggagcgtgttccaccccactatagttgtggcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccccgatgagaaagtaggaagaagctcctctcttcagtcgattgttgatttatggttccaatgaggctgctcatcctgaccttagtttcaggaacggaacccatagacctggatgcctaaagccagcttgaaacaagaccgccttctttggaagctttggaagctggcagtgactttttgccagcgaggtttcatttgtttccttgctcagagtgttcagacaactggatcaagcgtagtcttcaccagcggttgatatcacctcccacttatatgtgaaattccatgtttaggacttaaaattcaccggcaagtcgtgaatactattgcgtgacacttccttgcaggcgcagtaacagctttagcaaaaatttttatttgaaagttcagttttgtcactgctctttttggaagaagctgaaaatctgctatctcttgggggaaggattgcaggcggtttccatctgacagggatgttgtgtaccaggcagcttttccaccctgacttacgggagcaaacttttcatggtgtcctggctgcagcaagcaggcagtaaaaaatacatcactgctacataaatagctgacgatttgaggagggacctgacatttaaagaaaatcctattagctctagctaagaaaatgaaagccgcaaaccctccaaattttaaagtgggggagctttaaagtttcctactaattcagacagccatgaactagacaagaatggttatcttcattctcccgtttctagatacagcttctctgtttccactgtaaaacttcagtggaattcagtgtaaaaattcagtgcaaagaaaggacaatcctattctttaaataaaacatgttgcttgccccctctaatgtgtggtcatgaatgtcttatttccagggagtattccacaggtcctgattttgcagagatattcccttcaacaattcactttgttaattttgaaaaatataatttttaatacattctggtcttatagtccattttgggaaagagatgaaattttgagggctgggcactgtggctcatctctgtaatcccagcactttgggaggctgaggtgggcggatcgcttgagcccaggagtttgagacaagcctgggcaacatagggagaccttgtctctacaaaagcgttttaaaaaattaaccaggcatggtggcatgtgcctgtaatctcagctacgaggctgagttgggaggatcacttgagcctgggaggttgaggctgcagtgagccgtgactatgccactgcacttcagcgcctgggtgacagaaccagaccctgtttcagaaaaaaaaaaaaaaaaaaagaaaagaaattttgagttagcacgttcatcctggtctgtttttgaaaaggcagtttggttttctttcctctagagggaggtgtatctctgcgagcttcagaaaaatctctgaagtggtgcctggagtctcccagggtggagtttcagggtttgtagtaactcagtgatgaccatctcagcagagcttgcgggcagttttaggactgatatttcaatacatgattgtcattattatatttattgtggctgttcataataacggaagtgtacatacgttagagctttgtttttcttctctgctcaggtgtaagtgtattgagatgaaattgtgccatcaaaggaggcatctttgttcccaaacaattgcattacaagggtattcagcaaataagacattttataggaagcattttacccatatctaattacagaggtttaaatgaacagtcgggtgcttgagaaccaaagtaggtttgcatattcatgccattgcgtatccctgtagaattaccggattttagaactgtaagggtgctcgtgacatgtcctttgatactttcccctaataatggacaatgggttttaacatacttttaaaaattcacacaagctatgattatgaatgtctcgtcttgaatatttattaatacaaatatatattactgactctcagatttatgtctgttcgcttgagataaccagcattaagactctgagggagacaattctagctcagagcaaaacaaacaaacaaacaaacaaacaaaaaaaacaaaaacctaaccctttggttggtctttgtgttctcatgtttacttaagtttaacaagacctattgtgcatcatggccttgagccctgaggttcagggaggggatatatcccyaatgctaaawgacgagttgatgggtccagcacaccaacatggcacatgtatacatatgtaacaaacctgcatgttgtgcacatgtaccctaaaacttaaagtataataataataaaataataaaaaaagagaatacattcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagcagaattgtctgatgtttccaatatgcagacatcttggaatctggacatttcaagggggacaagcctttaagagtgtattttagggtgccatgtggagaaaggtactcttcccattcccagtcttccttggagtagcctcttttaagttgattcagcagaggagtaactgttgcttaaaaaaatctggaaagaaaaaggagagaagaaaaaaacaaatacgaaaagttctgccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcaggaacccagagcatcaggaattggtcactggaaggaagagctcatggctcggtttaatttcaaaattaaaaattgaacagcagctggagttgactcagatctcaagggaaaccattccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaatccagcatggatgatattttatcagatgttccaacttgatttttgaaaaggtttctgttttcaagaatgattttatcttctctacttgattataaattagactagaaaacagacaaaatatctaacttttctctttacaaagagagcacctttcagccactttaatcatttacagtggaacaccacagttttggaaaggtcagtagcaccttagttcattgccaagaaggaaaagacaggaataagtgccaagctccaatttggatccagcagcgtcacgtggcaaggagttggaatggagtgggcatttgtgcaatatttcttgaagcattttctaatgcacctttcttctttaatgttgaaatggaactagtctctgcctgatgtttataattagcagtataagtgcagacaaaatcttgtctggctgccgtatatttcagaatgtggaatgtgttttacatttgcatggtggcgtctagcttttcaaatcacaccagatatggaactttctgcctcatggttattatctgcaatgctaggaatatgttttaaagtaattttttcaaatatctgggtaattaatctggagtttcttaattgcctttgtaatgggaaggagacccacctctgaggagcttggcctaagcctggctgcaggtcggcatattcttacaggtgctctcattcacagagggagggcattggtaggggatgtccaggccttctctttctgcattgctttgttataatccacaagttgcagaacaggtgttgctttgttagattttaccaggaagagttgaagatctcgaatccgctactccatatctaacaaggacccccgtaagtgacaaaggaccccagtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaacattttcttttgaggattctcctttgggtctttcaaacaccaagagcatattaaattccactctcctcctaccctaattgcaggacttaataaatcctttcttagcttcctccctgaggaaaagaacggggactcctttcccaggattcgtgcaaaaagagagagaaagagtgagaaaaagagaaagaaatggggcgctccttcttgcagtctaggaatgggcgtggcaaaggcaagggtggatgagtgcctcaaatttactgaaatttgactttctatttcacagtcagtgtgcacggctctcccactgtggtctttgactatttccactgctcccattttaaacaggacaattaggaactaacagaagtcccagaacttgataggagggacaggctgattttaaaaagcagtgcttggagaaaaccaaataaatgacttcaaaatggaagctctggatttatttgagtctttgttttcaaactatttccttgtgtgcatgcgtgtgtgtctctttcttaaaaaagatttccagacatggaaaatgaaaaaggttttgagtaggctaaatgaaaactaatttacagaattgcaaaatagcttgggaaatcatattcattggaatatgattgaatatgatttcaggttgaagggccatgtagggcaatctttctgatgaaaggtatccttttaaatttcaaagggatagaaactaaacggaaaaaggcacctcaaatcctttttagaatgaggcagagtaaacaaaaagatgaataatcctaaacagaaagatgagaatgaaaatgtgatgaatgtctcttattgaatctgtttcctttaggacacagaatctaggatgaaggaacagaccccttccagcccaaggatctcaagcagccaattctgagtctttttttcatatttgaaagaatgatagtagacagccgacttccattgacatagaatctgtggtgtgtcaccaccaaggaagtctattttttccccaaaaggcatggggagtttccttgagatctgggccaaatctggcacagcctctagggtttcccggggttcttcccatgagctttggaaatgctaacttgggttagggttctggttctatgttgtttttatctatgtagctttgaacaatcactttgccttgctggggtttcaatttctcagctataaaatggagggaaatcagccatcggatggttgggaggagggcgtgaaatcccacccacaagacagaagcccaggaaacgttaccagcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacatgacaaacaatagaagagagttaattgcaaacgaaaatatcagcaaatattcaacagctgggctaggagcccacgagccacaagacctgcttcccgcatgatggcaggaaagtgtgtggggccaaaggcgtttttcccacctgggaattcagctcagtcaaaccatatgggttctgaatcatcagtggagcctggataacgcattgtcctacaggcattatctcccgtccttttcagagctggaagggctcctttccttctcttccctcccctcctcttccctcaatatctggatatattctggataaaataattcctgtgcacagtgtatttatcccattactttgtgttccaatgggaagtatctccactgagggggctactcctccaaagattcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcacaaacaaaaataccacttaaaatcatgcctcttgaacatggattaaacatttaaagtaatcgaactggatcttccagaagatttgcattaaaatttttaattgaagcagtgatgcttaaacttttggggggtgaggagtggcacaactgccttttagaatcacatacaaacatggacccttatctccagaaaaaccctcatccatagatgcaattttgcactcaactgtgggaggatcatagactctttgaatctgttgatcccgtattaaaacattgatctggaccagttacaataatacaggttgttttggaaagaacaggccattttcttagaaagaatctagcaggaagcttacctttgctaaaaaaaaattgacgctcaagcttgatagaacgaatcaagaatagcacatataaaatgtacttttatattattctgaagtgtatatcattatttaattgaggtcatacaaaaaattagatattgcaattgctttttttttttatttgaagaaacactcaggaatgggtctaacagactgtagggaagaaaggtagagcttggtggaaaagtctggaaggttcccagggttgcatgggcttgagggattcctagagagtgaaggggcaaagttggggctgtggcacggtgggggtagggtcaacctaagtggagggaggagaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaaggcaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacggcaaatccacgggactgagcttcaggtttcctttgcacccacttagctcctgtccttgactggcagcctcaatcactctctgtggctctccctgtacctttgctaagtggtccatctggacactagtctgctgctccattcatggcaaagttacatcactcatcagcyggacagactctcctctgctatcaatcttcaggtggcaaggctgagaacattagatcatcctcatccctgatttcattagctgtatggggaaaatggaattcctgtgctacacaacagacaaccatgaagacttgcagagcccatgggggcacctgtggagagaggaagattaagatagagatacaaaagctcaggccttgggtggagccgattccaaagctcagaggatactagtcaaggcagaagccatgtttgcaccaggtctgaatgttcatattagattctttcccactttcatgagactctgatcttctttgccaaaccctaacattttgcatgacatatactcttttcttatttctttccaaatcttatttagaagtaagggcaaacattgtgttatttgaatacagcggcatgtagacacactttaggatgtttagttgtactgttttttcctagtagctcttaaactctatcacacctcaaaaaagagatgctgcacttacatcattcctgttaaattgatggctacattttaggggtagttacccatgcttttaaaacctggcaaatgatatttcctgtcctcatttctattttaattgtggtaaaaaccatataacataaaacatactatcttgactatatttaagtgtacagtacagcagtgttaactatacgcaccttgtgctacaacaaatatctataactttttgatcttgcaaaacagaagctctatacctatgggacagtaactacaactgcctccctcctgacagcccatggccaacaccattctaggttctttttctaagactttgactactttaaataccttcacataaatggaattataaagtaatgcatttgtcttttagtgactggcttatttcacttagcataatatcctcaagattcatccatgttgtagtagataaaaggatttcattcttttataaagctgaataatattccttgtatgtggcatgtataagacttagtataatacagtaggccgtgcacagtggctcacgcctgtaatcccagcacttaggaaggctaaggtggaaggatctcttgagcccaggagttcaagaccagcctgggcaacatggcaaaaccctgtctctactaaaaatacaaagcttagctgggtggggtggtgtgtgcctgcagtcccatttactcaggaggctgagaaggaaggattgcttgggcctgggaggttgaggctgcagtgagctgtgatcgtgacactgcactccagtctgggtgacagagggagaccctgtctcaaaaaaaaaaaattacagtataagtggtgtaataacagtgcaaagtcctaggagaactgtaggaatagcagttaatgaatttaacaaatatttattatacacctacaatgatacagacaggcattttgccatactctgtgctcagagtgtggctgagcttcacagtcctggaagactctttgtttatgataaagcagccttggaaatctataatcaatttcataattgcaaaaaattccattgtgtgtgtatatatacatatatatacttaaccaaggaagaaaaaaacctgtgcactaaaaactataaaacactgttgaaatgaattaatttctttattcatctcatctattgatggacttttaagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgttgaagctcaaagatcatatacatgaggttttatttctgggctctctattctgttccattggttcatatgtctgtctttaagtcagcatcatattgatttcattacaccattttgtaatatgttttgaaattataagtgtgaggtctcaagctttgctattttccaccccttcattctgttaatgtggtgtatcacattgattggttttcatacgttgaaacatccttgcattctagaaataagttccacttggttagagtgtataatccttttaatgtgctgttgatttggtcagctagtattgtgttgagaatttttgcatcagtgttcatcagggatattggtctgtatttttcttttcaatattggccttataaaaatgagtttgggggtgttcctttgtctttaatttttttgagaaaagtttgagaaggattagtgttaattcttccttaagtgtttggaagaattttccaggagagacatctggtcctgggttttttgttttttttttatggaaggtttttgattaccgattcaaccccatactaattttaagtctgttcagaattttttttattgcttcatgattcagtcttggtggattgtatatttcaagcaaatatctattttttttctaggttatccagtttcttggtgtgctattttcctcacttcttacagatctcatgtagtcttgtcagtctttccaaagtcttgtataaacaatttcacgtgcctgatttgctctcatttccccttgctttcttcagggaattgccaaattattcctgatgcaggggatataaaaccaatctgtaagcatttggagttttagaattataagatgaaaaaagtcacatttcaaaatctgacatatacttgatacccagaaagatgtttttgattttcattcacactgatgctgaatgcctttacatgctgtaatctgtgaaacagacttctttttaaccttcaaaccctaacagtgaaatgatgatgaaaactcaatctccctagattatatgtatttcagtttcttaagtcaaatggaatttctaatttaactgtagtctacactatatcatttccaatatcaaataattcttcctgaaactcaatataagaaaaaatgacaatattaactagtgtcatgaaagttcatgctgataatgagattgagtctggtccttcccctgggcttctccggggaaatgtcagtcgtctacccattctaattctctcacttggtcacagggaggcagtgagctccaccatcaagggacatgggtcccacttacagttaatggagtccgagagagcagatatttgcaaacccagtgatctgggctcagtggaggcctgggcaggtggagatgcctttggttgctgcttcagaggagtaagagcttagcaaaattagacatggagaggaatagcccatgaaatgtgtttggggaattctgggttaaatcaagtacagcaggtttctttactttatttttcagaactgctatatattaaggtatattgtaactgttccagaaggaggcttggtattcagcactttccaaactgcgttgctcatggaatgcctgtttttccccttagaacatcgaatggaatgggtgttccatgaaatgtgctttgggaaatgctgatgaatgaaacgttgctggagaatggtagttagagttcacttaccatccattccgcgtcaggcatttaccaaacaggctaccacatgctcctcacagagggctggaagagaggcatggctatcattgttctgtgttatagaggaggaaatggaggctttgagcaagtataccacctgcctgaggtagggtatggtggatccaggatccagatttatctgattccaagcaccttgtctttccccaacatctctggctccttttctgattcctaaaaagcccaaattcaggctggtgaacttgattgaaaagttgctatggaatcgtggggttttcatggagaaataaaaatgttcttcttatcctctcatcttatgaaccctcagtgtggcaggtgctattgagcaccaaggtgtctgaatagttgtgcaccttggccacttattctctgcacccccattttttcctgtaagcatgaggatcagcatctacctctaaggataatgtaaagataaataacacacattatgaaaaattatgaaaaactgcaatgatcacatagtagatgctgaataacttttgataacatggcacccaaaacagcggtttaataacatcctagcctacctgtgtcgccaatggccttgttccccagtactgttacccaaacctctgaaaagggaacccctgaccagagagctcctaactggggaacccctggccagtctgggtaagaagagtcactgacatgcacatcattgcaaaatgaaaatgagcttctcgttcaaatgttttaagaattccaagatagcaacatcaaagcatcaaactgagcatggggcccttcagagcacagggtcctgtgggcagccccgtctgtggtctaagaaaaagttaaaggaaaccagaatcctgcattaaggagaggagaaaaaagatgctgtcctggcaaggggacttcagcctagacagaaagaccctagctctctggaggggtcttaagggagaccccagcccccaagctgatctcttagattggagattggagagtgaagaggctgtcacaagatcttgtggtaggaagaaaaggtgttggcaggggaaaggtctgatggcgcacgctactgagctgaagtgaatgtgaacttggctggtggggcatcatgtgtgcggcccccagaggcgcgtgggtatgggagactctgcatcagggcagttagcctccaggtctggcttcacagtcttactaattaaatcaccccaggctcattccactgtgagattggaggttggcatatggcagattttccttggaggaaaagtgctaaatattaatagagaatatggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctctttgcttaggaatatgctatttccaaattgctgcgtacatcacttagggaggaaaagaaggtttaattgcatagctttttagctgtggccaaagtaatagtcactagattcaaaaattctcatttatatgtttaatcaaaactatctttcataatggataaatttttcattcattagtaatttgaaaaagaaagagaatattttcagattgtggagaaactactatgaatgcctattttctaaaaatgtaattgtgttctttgaactatgtttaagaatgtccagagaggagagtgagcagtgccattacaggtgacctatgttctgctaacaagaagaggtctgaggtccctttagacagagagctctgcctattcacttctcacttacctattctttaccttcctcccaccttcccaccttgcctcctcccttcctccctccctccttccctctctccctccctccctccctctctctctttctttctctctttctttctttccttctctctttctttctttccttctctcctctttgtttttcttctgcttctttctcttcttctccttccttccttccatccttccttccttccctccttccctccctctcgccttcctttctttcccttcctttccttccttcacttcttccttccttcccttctttcacttcttccttccttcccttcccttccttcacttcttccttccttcccttctttcacttcttccttccttcccttcccttaccttccttctcttctcccttcccttcccttctcttcccttcccttctccttccttccttccctccctccctccttccttccttttatatatgcatatatgtgcgcatgtatgtatctgtatagatttttatctatctatctatctatctatctatctatctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatcattctttgattttagatcttagacatcaggcactgacatagagcttagatatgttcttaaggtagctaagccatttattataggatagtcagataggatagttytaggatttatagrccttttcagatactctttatccagtgagagatgacctatttttattaaaacttgggtttggtatcttggaattggcttgaaaatgatttgtttttacattggatgtgaacggaaagtttgtatctcaaatgttttaccacctgaagggactttccacatttctggcattggctggtctctgagcacataaagtagggagaagtcaatgattgagagtaaaaactattttccctgaaaaatacaaagatcaccctctctctctaactccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttggcctctgagggattcttcctccaggccaggttgctcttagatggagggaagtctagtgtcacttcaatggaagaagaacgtgggttggggcatcaggtcagcctgaggtaagtagagtccagcagcaagcctggctcacagctgcagaagggcacctcctggggccactgacagcctgataccctgagctcccacccttgagggagaactgggttcatctggaaatgagatagataatgtttgacatctatggagacttttctggctctgaaaaatatgcagtaactaatagagtacagtttgttcatgctcaaaaaatctggaaaaaataagtcttttcccttctctacatttacacaagtcctcctcgcttaaagaacatgtatttattatatttatttttcacgcaaattacccaaagcattgggggttagtgaatggaaaatagcaatttttacttttccttttttgtcaaggcccggttttgtattccaaactaaagaatgaatttataaaatgatggttggttgtctgtgataagacttccttctggtttaatcaggtgggtcttggggctcaaactgccacagggaatcatacttgagttaaagacagcccaggaaattgtttccccaatctggagcatgctactggcccattcatgatggtctctgagtatggaacttgggctagtgactgggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtggattcctcttggaccattggagaggaacatttccaacttgttcgagagtttctatatgatgttgtaaaatccttagctgtgggagaaaatgatttccattttgctctggtccagttcaacggaaacccacataccgagttcctgttaaatacgtatcgtactaaacaagaagtcctttctcatatttccaacatgtcttatattgggggaaccaatcagactggaaaaggattagaatacataatgcaaagccacctcaccaaggctgctggaagccgggccggtgacggagtccctcaggttatcgtagtgttaactgatggacactcgaaggatggccttgctctgccctcagcggaacttaagtctgctgatgttaacgtgtttgcaattggagttgaggatgcagatgaaggagcgttaaaagaaatagcaagtgaaccgctcaatatgcatatgttcaacctagagaattttacctcacttcatgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggcgggtgggccagggaagagatgagtgttcacaggtttaaaaacaaaggtttgatttggaatattcttccatagtcttctccccaagtagggcattcacctacatacaagaagagtctttttttaaacaactaatattttcagtctaaaaaaacccacattctaatattatgatcccacaaaatacctctgccttccttagaaaagaaagcctcagagtggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaaacctcagctatgatccagtctagattgattttggaaaaaatttagtcctgaatggttagtgacagccggagctggaggctgtgcatttgggctgtgggtctggtcttcttatttcttctccatgcggtaatcatggctgtgcccacagagactcttctaattctaatggagttgatgagaaccactctggaagtattgagagcacacggacattgcatcgatgtgtcatgtgcagttgcatgtacagagctaattggccgacaggttatttaaccagttaagcctgttagctctccttccagggctaagtgcctaaatggccaatggggaaggaatttgacaagtacaatttcaaactctaccataccacagcaactgtaatgagtgcccagagcttactcatcagcgatgggcagagcagagggacctccccttgttagaaaatgagtccatgcagccatttgatagttggtagcagagaattctgggtggaatgagcaggaaatgagagaggaatccagggggagagttgagctccagaaaggagacacacatgttctctgagatggagggaaggcatgagaaaaggggctgtgtttccaagatattcaggtggataagaggcacattgagagagttcaagttgagttgacatccatcatctcaataaaggagggaagcagtggggcttgggggcttggagggattgaagttatttttgatcagctgctatagggatgtgaagaggggtcacaaaacattcaggaagcaactgctgatttgaagtggcatccagttgctatcagagattacaagtcagtgggtgtctccattagtgtggatccctgcctttctgcagatatctcaggcactcccaggatcaaaggagttcccagaactggaacttgcaaagagggaacaatagagaggacagaagaaaattttctcagtaaggaaatccagagtggtagctagtaaattcctgaaacagcctgccatggtgtcctagctgcatggggagctaatgagagctggaatgggccaggagacctctgaagagccagaggatgagaggccaggtctcggaaggagagtcctggagacagctgagtgtgcaagttggagacgctgctggtgtgtagacagggagacctctgagggccaatcgcggggctggaggagtttccaatggtgctcagtgtggtcctcagatgtgtaggaactatagagagccagccactgcagaaaccagagagggtggtgctcacaaaggttgtccatacagaccttaaagtctggagatgaccacagagtctgcagtgtgaacgcaggctgaacataatgtaactaaatcatgtaggaatgttggagactctcttctgtgtatttagtaggcatgaggaagtggataattctttgaatcaaaaaagaatgagtgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggcacacatcactctacaggaccacatcggagggacagcagaagaattgcaagattgcaatcagaatgctggagcagttgcagagaagcagtaccagatgtcagtttttcataacaaggattcagaaagcaggagctgaagagagatgacccaacatcagcagaaaggaactagctgtcttgagcaggcagaacttgatgaagaagagggtttcagaactagccagctccagggtgtttcagaagtttgttcataaaatggttttcccagtggttactcctgatttcagctttaacggggctggcagtgctgatgcccttacctgtgggtctgcttctccataggaaagagtgagaggcagttcaaacactgcaaagtgttccctgcttccaaatgacaggcctcacccctggcattaccacacaggcatcagtcctgccaaatgacaggaaaagctgggtgtctccaagagcaccccaaaccaaacactcaggttaccaggaaatgacaagagggtatctacaatgaactgcactcctcgctacgatagtctcagtatcattaattccctgatccatcacatttcggaatatcgggataataacaaagacctaccaaaaaatagtgaaaggggctcacgcctataatcccagcactttgggaggctgagacgggaggatcatctgaggtcaggagtttgagaccagcctggtcaacatggtgaaaccccgtctctaccaaaaatacaaaaattagccaggtgtggtggtgggcgtctgtaatcccgggaggctgaggcaggagaatcgcttgaatccaggaggtggaggttgcagtgagccaaatttgtgacactgcactccagtctgggtgacaagagtgaaactctgtctaaaacaaacaaacaaacaaacaaacaaacaaacaaacaaacaaacagtgaaagggaccagtagagaaatggaacatcttttattgacgttttgttatactcacaaaaatagctgagtttgcctttatgtttaaccattatgtaatggacaaacaatgagattaccatagtgaatgctaaatgaaactaccaacatcgtgtgtttccacacagatgataaaacctttgtttttatgccaagaaagcatctctgtcttctagtgtccaagccactagcagcaccagggcagaaaattaatccattcatgtgtcttttctaattaacatcactctgcagttcctcctagtaccacgtcccgctgcatgttccacggcaaaaacataggataataatcttaggaagaacagtacatctctgcttatagttttttggaaagccagttagaagagcattatagagattgctaattagttagggctgcctcttcttactacctgtctgctgggtaacttccccatagagtgttcttgattataaaacacacatatgtgtaaaatatgaacgatcaccactgttgtcaatgaactctactcaaataatcaatctctaatggttgtgtttttaaaaatccctctgtcattctttaaaaaaatgaatatacctgagatataaaacctttattttaaaacaaaagctaaaggtgacagggaggattttggcatcagctttcttttctctgtaaaggatgaagatttttaaaatttgtaaaatatatatacaattttgtgttttacataggaaacaagaatgggaacttgtttttcttaatgaaaggaggcatcacatgagctaagaaaggcattgtgcccacaccagtgagctcgggaaaagagcttccagggatgtcaaaggaaactgtgaattttccttggacactgtaaaacttttctgtagaaaacaccacagaggatgtgatacataaagcatagaagcagaaaaccagacaattttaaagcttttaaattgtgcatagatctgattccttgtaacattaacattggtcattggtccgccttgctgtacacaagcacacatggcccctgtgtgcccttgaggcttcagctctcttgaataacaaagcatgcccttgtatgtcccattattgtgtgtgtaagaggataatgttgttattcagtgatgacaaattatccaacgtgtttctatgactggccactgtagatgttcagtcttttacaagagaatgttcaaggattttccctcagggtccatttatcttatttgcatgactataaatttcaacccaaaagtaagttacaaatggagaagaaatagtgttatcctgcgacttagggatcatttttaaaagcttgactgtattgatcatatttaatccttcttttaaacgtcttgatatgctgaggaagtggcaaatccttccgtgtcctttgaggtcattggtttaggcctgggaaatgttgaggaattttgtggaatttgtggagcctctgtattatgcaatgatgtaggccatttctatggccttctgtgtaattcacaccccctggcaccacactctcttgaagatccttcaggaatcttatattttggctgaacagtggcaaatgctttgggccctaatcaagggcctagtcttatataaaacttttgtgtggcaattactaaaaacacaagatcttaattactgtagcacaacaattatcctactcattgtatcttataagaaggattgtgatagcaatgttgccaggttaatatatttccctatgcaaagaattaatctgcaaatatattgttaggaactttcttgtatattaggaagggaagagggcagttccgaacctggcaatctctgtttcagttcacacaatgagaagagcttgggtaagaatgtaatttcactagagcagaactcttcaattttgtgagacaagctttggatccttttctacagtgagaacaaaaacaattttgttggcacaaggaaacattaattttaaatataaaatgttcactgtcattgaaaagatcagagatcagagtgaatggtcttacctataatattaccatcatttaaaaatgataccctgagtgtagttttctggaatcccagaatataaatagataagctcaagctcacatataatctcttcttgtccctaacacatactcaagttatcaaaaacatcgactagaataattgtgctcctccttgagtttaaatcagccaaatttaaacattcgaactgatgctgtgaaatctctggccctgacttttagatttctcgatccctattcctccctcagggctgctatataaccccgttctcagcatcaggttgggaattctctgtttgccattatgggggagagaagaggtcttggtcagctgtttttctgccctttgtataaccccaggctaattctaatcagggtttattcgatgctcatggtccttctaggtaactagtttaggatgtcataaaaacaaggttggataattatgtcatgaccggtttcatatcactctgcttaacattgttctgcattaagtgactgaatatagaggcaatgacaaaataaatgaacaaaacatcctgcccaatcccagacctgcatttgagttttatgcaactaaacatcatttgagaaaaaagaacaacaaaaatttcatcaaagtattttttacatgaaaactttaaatgtagtttgagttctgattcacgaagttgcatgtacaaggtcattttggtttttaaagaaaagagaagaaacaatagtttctgaaggcatccagcaacatactgggttgaggaatcaccaaatcgtgactctgttttgtagctgtggatttgtataaaaaattattctaatcatttgaggaggcaggagaaatgaccaaaaattagaaatcatctctaaagttttggtaacctactcattgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggttgcctcttatccattcagaatgcagaactgaaagagaatttcacattccttcatcaacatgtgttttgtttgcccatatttcgtgtttcttattggtttccaaagaaacatgtcagaacactgaataatgcatgtggtcacttgttctaatgctttcacattttttgcatttctttcttttaaagcacaagactctgctgacattattttccttattgatggatcaaacaacaccggaagtgtcaatttcgcagtcattctcgacttccttgtaaatctccttgagaaactcccaattggaactcagcagatccgagtgggggtggtccagtttagcgatgagcccagaaccatgttytccttggacacctactccaccaaggcccaggttctgggtgcagtgaaagccctcgggtttgctggtggggagttggccaatatcggcctcgcccttgatttcgtggtggagaaccacttcacccgggcagggggcagccgcgtggaggaaggggttccccaggtgctggtcctcataagtgccgggccttctagtgacgagattcgctacggggtggtagcactgaagcaggctagcgtgttctcattcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttctcaccatctgtgtgggagtggggtgttgtgtgtgttggtttacatagacgtaaggtgggtaccagcatgattcgccacgggagaagctgtaagtacccacagtccagtccttccctgatgagctgggtcctggatgtcatgtttgtgatgtcatgtgtgcggaaaaactaaagaccaatgagtgagtgaaagctcttacgagagtatgagttgctgagaaagcgtgcttttaaggctaattcaacaaacctgttgctttgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattttgtgctagggtgctgagagttatacttctgaaggtaagaaataacagtgtaatcacttgatgaaatatttatgaagttttttttttcttgtgcttgtgaagtgtaggagtaattctcctgagtggcaatattaggatacaagctcaaatggagggcctttggcaaaacagccaattggagtggtttaaaaaacaaaaaaaccaaccaagtcacataacaaatatgcacttaacaaacataggaggtatggtgggggcatcaggatgcatagcctcctctaccttttgaactgttttctgagacatcagtcacttttcagacctatcaatttcattacctaggtcaggccaataggatgccatttggtaaatcagggacacagtggcccccaacagtttccagaaacacccaactcacttccagtgttgcttacacactgggatgctctaatgagattagtccttgactataagaccttattcttcattttccttccagagtatgggctcaatgaaaattggtgaatggataccgaggctcctataagactctgattatcatctgcaaccaatcatctaaattttcttgggtgaaataacacattgttacaactcttatttgctaactttataaataaagtctgggtctacaagataaatattgtaataagatactgctttacccattgtatcaattacaattgatcaagggaggttttcctttgataaaggagtgaaaataatttaaaaataaccattttggagaatatgccattgtatgaaattaagagtagaagattttaaagtcttaattaaaaacatcactatctatttatttaaggagctgacctctacttaatagtgccttgctaatcattagttctagttgctgcattcatgtaaaggcaacacaccacatttccttacaagggttacaaaattcacactgagttagattgaacttgcctcaaatgattttaaaccacagcttttgttgtaataaaaattacaggtagaaagctcaggctatggcatctctacttaatctgtgcattggaactgtgaccaggtgatgtagcaagaaaagtatatgtgagtgttgccttctggagaaggctgtgtctggcatttatttaagtttgaaaggtcaattctgtgtggcttagcttttgctgcatacagttttccagcttttcctctcacttgatgggaccataaaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttatgacctgctgaggtttctctgagcttgcatactattggtgtgcatcccaaagtatagaagcccagagatttccctatgttttgcagacaccgacgatgcaacatggctgtagatgggaaagctggtctctggtcttgggtcttctgtggacctgccatgtgatcctgggcaggtcatgcaacctctctgggtttcgatttcttgaatttatgacaaaggagttgcaccagatgaagatatgtctgtaccaggagaagtttcaactttttaatgaaaatgggcagcacatgacccttgtttcagattttccctagccaagtagagtttcaaccccttgattacaaacatcatgtttaatatcaatgattaacttgtaaatattcaacaaatatccttgactatctggcatgtgccagacactatgccaagcactagagatatggtgctgtttaatgagacagatgtggctgctcgtctgttacaggataatggggaaagagacaataataatataaactagtgaccaggcaaaatattctgagcatgataagttgcattggggcattcaacagggctgtgataggaagactggggaagggaattttagatcaggtggatggaaggccctgagaaggtgtggaaccgaaggcagatgagcatgcggagagcagggggaagagtggtccaggcagaaggaagagcaggaggggtggccctgcaacaagaaggcacttagtcccttcccagaactgtcagaaggcagtgtagctggagcacactggacagggagcctgaggttcagactccctggatgcatggaagctggagaagcagctgctgtagggggatgagaagccacagggagtggagcctgtgggttgggagccaatggcagaggaaggtaggctgtgggttagtggtgggggcaggggctctcctctgagggcttctattttctcagagacagatgaggaggccttggaggcagtggcagagggctgagcagagagcacagccatgagacagtcattctggaggacaggacagccaacttcccaaggaggcatgggaggatggtgggcaggcacaggtctcctgatgggggtctggagttccgagcgtggcatgcaggtaccttgttgtgtggtcttctccaggaatgtccactgcttgggtgatgcatgaggaagactgtgggcctgatggaggctttcaggagagtctgatggaggtgcagggatgaggcatggaggaaaacagagagaggcgtgggaggagggctgaagagggttgtgccatgttggtgaggagtagcaggaccttcaagttcatctcccaacaaggcagtgaagtcaggccctgcagagccacattaaagagataagacagctgtgtttgggttgatatttatgtcaagtggaaggaaatgcgtatgcatccctgacgtggctcacagaagagtcagctgtgagaatcccaaggtttttatcactgggtcagaggagattcatggtgcagcccccagagaaatgaaatgattctgcaaagcctaggtgaattgcgtcagagtcatgaagcaaacataggaattcagttattcttccagttactcaatatttttcagtgtttactatatttggctaagcatggttctaggcatatcatctgtcatgagctcccatgacttgaataaaaatcaaacgtaaatgacctcttacctaatcaaaggggactctgggacagagcctctgggaaccagaggtgcatttcagggttcccagagctgaatccttgttgggtgcaaggagactaggccacttgtttcattagatctagaaggtattccttcccgctggctcatcgggagaacttttagtgatgcagtggtagggggagggaaaacgtgggagggtaggggatgatatttatcttctcccaccccaagagttgtgccattgctggtacttataaagaagaatataacaatctgggccacttggtataggagcaagtagcttctcaggtcattgttatatgagtatttgtctatttttctgtcatgtgtgatatacatagtaaatacatgagtggtagattcatggtatagcatatatggaatttatatgtgtctatatacgtgtatgtgtgtatctatatacatatatattctctctaatggtacaaaggtataagtcttctagagatctacacattagttttatctgcaaagatattttaaatcaaaatgaaggggtagcccagagagacagcatgttctaaattaaatgaaggaaggaaagcccagaatggatgttcataacaatgaccatgaaatattgagaaaaggttcaatgatgttctgcacacattgttacaccagtaggcaactgtgttattgtattaaggacgttggtgcataacatgttacccttctcttagaacatagaccttgtcttgatgctacaggtgakyacccagatgaggcactgctgtcttcatttggcatgtatcagcgattctcaccccaggcatcacgctcccagcttctggtccaaacaactagaaatgaactgcatttcaaaaatgtgttctaggctggatgtggtggctcacccttgtaatcccagcactgtgggaggctgaggcaggtggatcactcaaggtcaggagtttgagaccagcctgaccagcatggtgaaaccccatctctaccaaacaaaacaaaacaaaacaaaaattagccgggcgtggtcgtgcatacctgtaatcccaactactcaggaggctgaggtgggagaatcgcttgaacccaggaagcggaggttgcagtgagctgagatcatgccactgcactccagcctgggtgatagagtgagattctgtcctaaaataaaaataaaaataaaaatatgttctagaaggtagctctgattcttagaaagttcttccttaccttcatcccaaactttgtttcctttgtctgcttttacaaaatcaacttgccatgcaatctatctgatggaatacagtaacagaggactcttttgcaaaacagtccatctcaggtttaatcatttatgttcctctacttcttggaatctctgtcaggtttttgggttaggtgttgtggtcttaacagagttcatggttcttgcaatatgggcagggtgcctgcacatggatacagcagttcacagtcactgtgagacagttatcttattgagatgtttttgctttatggtttgcctttaagttatcactgtcatattacttaggatctttaaaaacaggttttttgttttttttttggagatgaaatctcactctatcacccaggctggagtgcagtggtgcaatcccggcttactggaacctcctccttccaggttcaagtgattctcatgcctcatcctcctgagtagctgggattacaggtgtctgcccccacgctcggctaatttttgtatttttagtagtgatggggtttccccttgttggccaggctggtcttgagctcctgaactcagatgatccacctgcctcagcctcccaaagtgctgggattacaggcgtgagccactgtgcctggccaaaacgcaggtctcttaagtgaaaaatgtttgcggcacttgctggctttgatgctgatttcctttttatacgttttatgttaagtaattctttcgtctgtcaaatgaagacagggaatatagaactgaagagaacagggatgtgcaggctctttcagcttttgcacttgacaatgagcattttgaaatgaagactgtgaggcaaagggttctctgagcagacatcagtggtttctttaattattcaagcaatgacttcactctggccaagttgtgtatttacggcagaagagaacttattgaattttcagtgacagcatacaaaacaggtggctactaaaactaaatttgtttttgtgcaactattttgtaaaaagtactgactgggcagggtggaaggtgagccagctttcctccagcaggtggggaggcaaccataacttatgtgttcattaggacaaattccctttggggtggccctgtggtcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatccgagacttcattgctaaagtcatccagaggctggaaatcggacaggatcttatccaggtggcagtggcccagtatgcagacactgtgaggcctgaattttatttcaatacccatccaacaaaaagggaagtcataaccgctgtgcggaaaatgaagcccctggacggctcggccctgtacacgggctctgctctagactttgttcgtaacaacctattcaygagttcagccggctaccgggctgccgaggggattcctaagcttttggtgctgatcacaggtggtaagtccctagatgaaatcagccagcctgcccaggagctgaagagaagcagcataatggcctttgccattgggaacaagggtgcygatcaggctgagctggaagagatckctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtgtgtttgtgtttagctaagagacaacaaatgatgaaaacagcagcaacgaacatgatttattccaggtttccttttgcactgggttcaggattgtatggtttacaatgtcatgcaatgaaatttcatataagaaccatatgatttaaaccacaggaccatgggccaccacctgtctttgaagcttctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctctctcgttaagggattaccctcaatgggaaagcatattgaatggctaagtgtggagttcaaacctagtggttcttcaaatccctcatttaatatgattgccagtggagagttatttttaaagacattatacagatctatgagctaatgagttgaagaaatacaattcactgcccttaatgaagagaagatgagcatcacagaatgatgctttcccaccttgcagactcgatcactagaggattgcctgatgcaggcatgacccatgctgcctggatgcatgctttctcttcacactccctggtcttctatatccatctctttctctctcttttaaaatttttcttaaaacttttaatccacactttcatagccaaagttcaacttaggatacaattagttgtgaggtctaaattacagtagggcatcagggaagaaataaaaaataaaattttaaaggcacatggtaaatgtgttgggtcaaatacactattttgagaattatactttttattcttgatgtgtataagtttggccaagcctagcaactagtctccttctattttgctgtgtatttacggtcccatcatctcactttgggggaattcccctgttggatgattgcctagcaagactgtgacttcctaataggagaagagtcccagtggagaatgacaaacggggaagtctgaagaagacttcaatatgagaccagcctacttttgctattttttttagccttaaggaactcgttttctcaggttagtgagggctaactgcttctgagctatggatggaagaccctctgtttgtgggtagaggtgagccccagaggatccagccaggcaaacttaaacctggctgggatgagtgatatggactgatgcagcaccttcatagtattcatttttagggaaggagtgtttggtttcaaggattctgatcacttttgttgtctgtaaacattctaactttgatgttgtagctctctttgagccaacttggttttgtaaactcggctaccaatatgtctcacaaacaccagccaccaccagaggaaaatatgcagccatctgccatattttacaagatggacatgctttgccatgctgactttctctgtgttctaaatgttggcatgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcrcgactttgtaatgaacctagttaacagccttgatattggaaatgacaatattcrtgttggtttagtgcaatttagtgacactcctgtaacggagttctctttaaacacataccagaccaagtcagatatccttggtcatctgaggcagctgcagctccagggaggttcgggcctgaacacaggctcagccctaagctatgtctatgccaaccacttcacggaagctggcggcagcaggatccgtgaacacgtgccgcagctcctgcttctgctcacagctgggcagtctgaggactcctatttgcaagctgccaacgccttgacacgcgcgggcatcctgactttttgtgtgggagctagccaggcgaataaggcagagcttgagcagattgcttttaacccaagcctggtgtatctcatggatgatttcagctccctgccagctttgcctcagcagctgattcagcccctaaccacatatgttagtggaggtgtggaggaagtaccactcgctcagccaggtaaacctcccctgttgccgggaactccctctccttcctcagacaccaccctggagggtagtttgccagtctgaactcaagagcactgtggactgtacaaagacaattggctcccttccattgaaatagtttgaatggggacttgagacactgtaccagcaaggctggactctgtctaaagggtgttcacgaaggaaagtctagaacatccagcttatgttctgtccattttgcctcaccctttattcagaaggattttttttcctctaatgactgtgaggattctggagttcgaatccagatttggggatcatggggtggagggagacagagagagatttttcttacatgaatatgccttgggattatttaaacgttgaaattgtatttttacatgatttttaaatgttcaacatctgctgtatctagaaaattatttgttataaaacaaacaaagggtgcatcttcatgcaatggtaaaatggtttctaggggaaggctaacttattattattattgcaaattattatggtggtaagatatggttgtatcagatctaccagtctgctaacatcacacagatgaatggcaagactaaaccaattgaaacctaatcaaaatagttctaagaactgttttaactgagaatgttatttacattacacattgcggtgccatagggcctgtcatctgtgtttcctattgtctcattacaacagattgggaagcattgacaaggagcctgacccacacagcagtaatgggcactattgtgggtcttggcccgtaacctcaaatttaatgatttgatcattcaattacagcagattcatggcaacccagttatctttgagtggttgacccatatcagccccccctttttttttctagagattgagatcaatttttttaagcaaaggtatattaagggccatgttttcaatacttttatttgtaacagtttgaaactgctgtctgttttcctggagcgattgccacctgatgtaagaacacaacccagtggggcttttccctggcttgctttattgaagaagcatgatgctagatgggataggctgttctagttactagctttgcaaatatgcactgatttgaaataggacattttcaagacaagtggtatgaatttgggttttctcttctcttgctggcacagtggtcatcagatgagtttcaccaactcctgttgtcaaatggtgctgggctgaagtcgctttggttcctgttatgctctcgtccctcattgtatcctaatctaccttcattgcagagagcaagcgagacattctgttcctctttgacggctcagccaatcttgtgggccagttccctgttgtccgtgactttctctacaagattatcgatgagctcaatgtgaagccagaggggacccgaattgcggtggctcagtacagcgatgatgtcaaggtggagtcccgttttgatgagcaccagagtaagcctgagatcctgaatcttgtgaagagaatgaagatcaagacgggcaaagccctcaacctgggctacgcgctggactatgcacagaggtacatttttgtgaagtctgctggcagccggatcgaggatggagtgcttcagttcctggtgctgctggtcgcaggaaggtcatctgaccgtgtggatgggccagcaagtaacctgaagcagagtggggttgtgcctttcatcttccaagccaagaacgcagaccctgctgagttagagcagatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttagatagaagccctccttgagtttacaggaaaggtggaaaattaatcacctgctggtttcagcaggaacaatagaatatgagatgtccctccttactttgattctctagctgctctctcaggagaatgagggtgagtatttttaagggcattagattatttcatagtaagacatgttataaagatttagatatcagtggttaaaatccttttttaaaaacagtttttatggtatgcataataaaagccatatcatatggttacattgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatgcagtgaagagagtaatttcccctgtatgccttttgatgaaaaatgaagactccagagcctctcctttgattactgggcccattggccgttggcttgggatggtaactccgacatctgggttcygtttcctcccattaacccacttgtgactygcagcaactcaattgaaacctcccatcgataaaatgctagtggttgtgcaggtgctgccatctcatgtctctcctcccatcccaagttttttcttgaatacatctttgaaagctaacaatactcttcaagcattgaaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtgaaaccctgtctctaccaaaaatacaaaaattagctgggtgtggtggcgggtgcctgtaatcccagctactctggaggctgaggcagaagaatcacttgaacccgggaggcggaggttgcagtgagctgagattgcgccactgcactctagcctgggcgacaagagcgaaattctgtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgcattccttgcctcctggccccatcctccatcctcattgccagcagcttggcactttctctcctctctgacttctgtttccatccttacatcttctctctaactctgaccctcttaccccctcttataaggacacttgtgattgattacattgggcccacctggctaattccagggtaatccccccatccccaaatccttacctgaatcacatctgcaaagtccttttctcaagttcggggatttggacttggacatccctgtgatgctcttatgcagcccacctcgttgatatgaaattgctgctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggaccaggcccgagttctacctgaattcatacatgaacmagcaggacgtcgtcaacgctgtccgccagctgaccctgctgggagggccgacccccaacaccggggccgccctggagtttgtcctgaggaacatcctggtcagctctgcgggaagcaggataacagaaggtgtgccccagctgctgatcgtcctcacrgccgacaggtctggggatgatgtgcrgaacccctccgtggtcgtgaagaggggtggggctgtgcccattggcattggcatcgggaacgctgacatcacagagatgcagaccatctccttcatcccggactttgccgtggccattcccacctttcgccagctggggaccgtccaacaggtcatctctgagagggtgacccagctcacccgcgaggagctgagcaggctgcagccggtgttgcagcctctaccgagcccaggtacgcagggaactctttgcatcctcactcagtgtcattgtctggggctacttgtctggactgtgggccacaaggtgttctcaattttgcttttcctgccatgtgaagtgaaaactaaaattacaggaaaatttaggaacccacatgccctttttggcctcgatgggcagaaatggcagaggttcaaggggggagatgctaagattcatgttttggggcaaattaaattctccaaaagggacatatgtgcagcttggaattcaggactccttaactttgcatgaaagcttctgtctagatatccaaagggaggggccgtctaactgataacgcctgttgcgtatcagtcctgcgacccctggtaggtttggtcagcagccttctgtgaggcaggaaggagtctgaccagggacactctgcaagctgggacatagactctgaaatattggtatctccagagccaaggtgtgaagataattttgactttgcttggtgctgagaagtgtcttaactggcaggaaggccacctggctcttatgaccatagtttattctattttctttttcctgttccctctttctaggcctggtacaataaactaaaaaatggtgggagccctggtgctgagaaggaaggaggaaagatatatctacctctcaataaatgtcctccaagggccactctcccgggtcactcgggtggggggggttcacagtggcgaaggaggcagatgcggccttgctccctcatatgcactcacttgcctgctcttccaagaggagagaaaagaaggaaagttggggaggagcggaggaaggagtaaaagcaagtgaaaggaaatcactgcaggatacagtgggtgatgagggaggtgaggatgattatttgggtgcaactgagaggggcttggtttctcctcgctggtgcctggggaagagagcagtgtggcccaccaggtttctgtgggatgttcctgagcatttatgatcaggtaaatttgggcaacagtgggataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgtacatttccacaacgctgtggctctttgcccactcactctcctgcgctccagaacagcctccctctttcccccttctccccattcggaggcttctctcacacctctcctgacccacctgactctcagctggtaatcttgagtcctatttctccaagaaaatgcaagtaaacccaaagagagctgtccccggccacgtcatcccgtggttccttgggtggcctgtctccgcttcctcagctccctttcctctcacctgctcagtggcaccatctgcagttccctttcttgctcttgtgtcaccctttctccactgtgctggatggttccatccatgataaaatgcattgcttcttctctcttaaacaccctctctgatgcgccacttcccctgccagcagcacctgtctcctaaagacttatctatactctaaagttcctttcctcccatcctctctgagcccaccctactttgtcattcacccttgctcctcccccaagtgctccagttgaggtcactccatctgacaaggtccctgtctctggcgaagcccagtggctgaccctcgggtccctgagcagcacctgatgcagtgcaggtcacgtccttcccaagtaccatcctcgctggtgctgatgaggctcttctgattctgcctccgtcgggtttttcatcctttgctccccttctctttgatgtgtaaacactgaaatgcccaggactcccacttcttggacttttaacagtggtgattggtgttaggatcccctgcctgtgaatccatgacaaactgggcggtggctcatgaacgctaagaatttggtgacgatgaaggtgaagccatgctcacatttgtttcgcaggtgttggtggcaagagggacgtggtctttctcatcgatgggtcccaaagtgccgggcctgagttccagtacgttcgcaccctcatagagaggctggttgactacctggacgtgggctttgacaccacccgggtggctgtcatccagttcagcgatgaccccaaggtggagttcctgctgwacgcccattccagcaaggatgaagtgcagaacgcggtgcagcggctgaggcccaagggagggcggcagatcaacgtgggcaatgccctggagtacgtgtccaggaacatcttcaagaggcccctggggagccgcattgaagagggygtcccgcagttcctggtcctcatctcgtctggaaagtctgacgatgaggtggacgacccggcggtggagctcaagcagtttggcrtggcccctttcacgatygccaggaacgcagaccaggaggagctggtgaagatctcgctgagccccgaatatgtgttctcggtgagcaccttccgggagctgcccagcctggagcagaaactgctgacgcccatcacgaccctgacctcagagcagatccagaagctcttagccagcactcgctatccacctccaggtgagatgggggcgtcggaggttctccttggagcattttccatatgaaaaataacaggctcaaaggccatggtactcataataaattaaattaaaataaaggttgtatgcccttacctttatggtttttattttgagacagggtctggctctgtcgtccaggctggagtgcagtggcatgatcataactcattttaacctctgccttctgggatccagccaacctcccacttcagcctcctcagtagctaggactacaggttcataccaccacgcccggctaattttttgtattttttgtggagacggggtttcaccatgttggccaggctggtctcaagcccctgagctcaagtgatccacctgctgcggcctcccaaagtgctgggattacaggcctgagacaccgcgcccagcacctttatgttcttcatgcccaccagccagaccccaccaggacacacctgcgactgaacaagttgggtctattgctcatggcatccagggagaatgcataccgtggcaaagcatgagggcatctccataggagggtggccggaaggactggggggacttgagctagtggcaggtcattttgtggaaggcttaaagaaatggaactgtggcctggattggatgttgtcaagacgtggaggtgattctgtagctgtatcttaagtcttacctagaagcaggatggccttggtatagattggtagagaagagcagtcactcttattaaccaggacagggagtgtttttgtcctttttgtggtttgcaccatgtttttctttttgtctgtgttcagatagggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgctgcatttacaccgtaaattgcccaattgtgtatgaggcaaagggcaggttgaaatgtgtggagtagcaacatacaagtttaataaaatagcatctgaggagtacctaaaattctaactaataggaaaatgtggctcatctttctcaggatcttttgattaattttattgttaaaaatgcactaggctgggcgtggtggctcacgcctgtaatcccagcactttgggaggccgaggtgggctgatcatgaggccaggagttcgagaccagcctggtcaatatggtgaaaccccatctctactcaaaatacaaaaattagctgggtgtggtggcacacacctgtagtcccagctactcgggaggctgaggcagatgaatcacttgaacctgggaggcagaggttgcagtgagccgagattgcgccactgcactccagcctgggcgacagagcaagactccatctaaaaaaaaaaaaaaaaattaaaccagttatttaatagaattaaatatttttaaaaatgcgctaatgtaaagaaaatgagtcagggtgggtgggggaagctgggcatggcggctcatgcctataattctagcactttgggaggctgaggcaggaggatcacttgggcccaggagttcaagaccagcctgggcaacacagtgagaccctcatccaaaaaattaaaaaaaaaaattttaatgaaatttaaaaaataaaggcacaggcatggtggttcatgtctgtagttccagctacttggaggataaggagggaggattgcttgagcctgggaggtcaaggctgcagtgagctgtgactgtgcaactgcactccagcctgggagatagaaagagaccatgtctcagaaaaaaaaaaaagaaagaaaaggaaatagaggaataatagtgaaaaataaaaacttcatataaatgctagagatgtgtgagcaaaaaggaaatacgagggcacaaatgcctggggagcattaatgtgaccccttggatatggcactgtgttatacgtaccctgcccccatgggctgagattgcgcagcatgctgggatggtgttgggctcctcaggggtctcacttgctaagtgatggccttggacaaggcgagaacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagacacgttttggataacttcaaatatttcaaggagcagaaattgttttggtgtaaaaggtccaatttttaacggctaatttcaaaaagcccgagatacaaacaacacaggcatcttgggatataatcttaaggttgattaggattatggtgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggccccagtaaagtgagagttggggtcgtgcagttcagcaatgatgtcttcccagaattctatctgaaaacctacagatcccaggccccggtgctggacgccatacggcgcctgaggctcagagggggktccccactgaacactggcaaggctctcgaatttgtggcaagaaacctctttgttaagtctgcggggagtcgcatagaagacggggtgccccaacacctggtcctggtcctgggtggaaaatcccaggacgatgtgtccaggttcgcccaggtgatccgttcctcgggcattgtgagtttaggggtaggagaccrgaacatcgacagaacagagctgcagaccatcaccaatgaccccagactggtcttcacagtgcgagagttcagagagcttcccaacatagaagaaagaatcatgaactcgtttggaccctccgcagccactcctgcacctccaggggtggacacccctcctccttcacggccaggtatgcaccgtgtgacccatgactacagagtgtgacatcaacattttttttttagttaaaaaagtaatcagtagtcatttttaataattttcttctctctgggttgtttcttcagataatattagaaattaaatactggaaaagtagttccattgaaattgcagaaggaagcatattattgatcttccatcactcctgagactaatcatagccccattgaaaggttctgcagtgttgcactgagataattacaaactcattggctctcagaataggatggcatctttgaaatcagccagtccatgccccactgaatgtgactttgaagttggcccatgcctactggccagatgcccaatatagtccaggtcccctcattccttggcctggtgggaccatcagggagcaccttcctggaagacttgcagtcgtccacctcagcttctaccccgtgctcctggttctcgtctttggggctgcaaaagcaaagtggatctctccaccagcccatatttttctttgtccctcctccaagtaatcgccatgtagacatctgaagcaaaccattagggttggttcttcaaaggggagcagtatgcctgtttccctagctcactgctccctaccaggctgcctgtggcacatctcacatccctcacactgtctctcatcctttctcctctctattccagtctcagttgcttaattataatcaagaaattaccctccacaccactgatattcagccagctcctacaaagctctcagaccatcatccaaaggttaaggggcctcttcctattttccaatctgtttctcctagtccttccttgctttgcacctcacacacatctcttcacttccaggaactatttaaaattcttgaccacaaaggaaacttctagtggcatttcctaaaacacttgagatcacaaatgtcaaagccaggtccctattgaattcttgtcacaatgccattttgcacgggataactgaagttctctgtcactgagttttcacagagtgtgacatcaaataatttttctcctttcctttttgtttagaggatttatcattcatcttcttgtatttagcatgtttgggagctgcaaattcaggaactacaggctaaagaggcatggatttgagtgaaggtttcactgtgaataaattattaggaatgtcttatttcagttatttaattttaccttttgtgtatttatgttctgggtctggaaacctaatctctccttattttcactttaatcacttctagagaagaagaaagcagacattgtgttcctgttggatggttccatcaacttcaggagggacagtttccaggaagtgcttcgttttgtgtctgaaatagtggacacagtttatgaagatggcgactccatccaagtggggcttgtccagtacaactctgacyccactgacgaattcttcctgaaggacttctctaccaagagrcagattattgacgccatcaacaaagtggtctacaaagggggaagacacgccaacactaaggtgggccttgagcacctgcgggtaaaccactttgtgcctgaggcaggcagccgcctggaccagcgggtccctcagattgcctttgtgatcacgggaggaaagtcggtggaagatgcacaggatgtgagcctggccctcacccagaggggggtcaaagtgtttgctgttggagtgaggaatatcgactcggaggaggttggaaagatagcgtccaacagcrccacagcgttccgcgtgggcaacgtccaggagctgtccgaactgagcgagcaagttttggaaactttgcatgatgcgatgcatgaaaccctttgccctggtgtaactgatgctgccaaaggtaactcccattatgtgcatattttccatcctttcctgttgacatttgtgcctctttagctgtctggtccctggtgctgacctctggagtccttaggcatttggttgcttcatacatttacttatacccactgggactggtcctgacacccacctcaccactacctagggcgttcttccaagacaagagtagaagtctatcatattttgcttttataagatttacttttctcccctattccttaatccctcaaacaattcagatttattgattcctgtgtctaattatagatttattagatcaagtatttgagatcagaatatttgattttcaagtgcttttaatttaaagcacaaacttggggtgcatctaaacaccagtggtgtatcatcacaccaaagttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcgtctcctcagccccagctgagaactcatcacctgcatttctcctttccagcttgtaatctggatgtgattctggggtttgatggttctagagaccagaatgtttttgtggcccagaagggcttcgagtccaaggtggacgccatcttgaacagaatcagccagatgcacagggtcagctgcagcggtggccgctcgcccaccgtgcgtgtgtcagtggtggccaacacgccctcgggcccggtggaggcctttgactttgacgagtaccagccagagatgctcgagaagttccggaacatgcgcagccagcacccctacgtcctcacggaggacaccctgaaggtctacctgaacaagttcagacagtcctcgccggacagcgtgaaggtctgtggggccagttggttcaggtgctccctgggaaatttccaaatttttactggaaaggaggaagcccttcccccaagttaaatcctcttcatgtttcactggattgttagtgtctatatggaaaatcccttagttattaactgatctaatgtcatgtactgtcttcctcattttggtagtcttacgtaagctctaaaagaatcctggaaatcagtagtttaacttgaatgagttgaatttgtgattgatttatgtttaattatagtccagtcaggtacgttctccactttcatttctctgtgtgtatgtgtgcatgcatgcatgtgtgtatatacatgcatatatattgtgtagacacacacaccatgtgagtttgctagggatcatcatgaagtactacagcctggcgggcttttggaacagacatttattttctcacagtcttggaggcttgacatcctcgaggtgtcggcagggctgtttctcctgagtcttctctgcttggcttgtaggcaggggtcttctccctgtgtctccacatggctttctctctgtgcatgtctgtgtccaaatctcctcttctaaaaggacatcagtcatactagattaaggttcactctaaagatctcattaaccttaattacctctttaaagaccctatctccaaatacagtcccattcttacggtactggggtttaggacttaacatacaaattttgaggggacacaatttagcccataacacatgcacacatgcacacacgcacacacacccacagacatgcacccacatacatgcacgcacatgcacccatacacatgcacacacatacgcacccacacacatgtacacccacacacccacacatgcacacacaatgcacccatacacacacatatgtacccacacacatgcacacacatgcacgcacacatgcatgcacacatatgcatatgattcgcagaaactacatcttagaaatatgagaatgagataaaaattgtttttattgtcattgctgcttgtcttttttaaaataaattaagcactcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcattcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttcctcccagcgttgtggcccttcatcacctgcttggagctgtgggatggagctaacaaaaattccttctgtacttagacagctttactgttgtgttgtggctgttcaggtggtagaatgttcagaaagcatgatgcttttgcaaaagatcatgacgtattgattcatttaacttcatcacataaactaggaattagttactaataaaaatacattgctctatttttggtttgcagttatcacagttcaacatttaataacactacacccaaataatacaaagaaaataatgtaagcaatgacgtaccaaacataaggtgacagccatgcctattatcagatgtgatctttgactattcacttgctttggcgtttggtagcactgactatcagaaagtggatgccattacagaagtgtaatttatcctaagaactttctatttattagcttacttttcccaagcaatggagatgaggctgctattatctgattttggaggtgttagtatttcaatacttcccacagcatactcgtgttacagagggcctgagtttgagaactcatgcatgaatacacttcatggatgccacttcctatatttttagtaataggtttagttattgacataccggaaacaattattcagcagagtccaaagtttgagtatttcaacaattcagagtagccagtaaacttgattaaatatatttaagttaaaagctaaattttacactgaagttttctttaaaaatgtagtcaggaaaaaaggacattgcattttccacatgcctaggtgagctgtattaaatgtgtctttctttgcaggagtccgtgccttgatcctggtgggccttgaacgagtggtcaacttggagcggctaatgcatctggagtttgggcgagggtttatgtatgacaggcccctgaggcttaacttgctggacttggattatgaactagcggagcagcttgtgagttttttttatgtctttatacacagaccagtgtagataccacaccttttggcatttcaagagaatgaagttaattatcagcaggtgaatggaggtggggggggggccttggtagatagttaaatttatttaattcacttgggaactgccttgttgccataacacatgtgaatctggaaatggagatagcaaatcgctggaaatccagcgagctggaaggggatcctgggcgcgctgaggttgtggccttagcattttctctgctcccttagcaacggcctcttttaacaccattgcagggatgcaaaccatcgagattgtccatcctccaattggaaactgtgtcaagagcatctgaaatcttgcatgataaaaacaacatgcaggaaaagaaaggctgtttctgggtggagaagtgctttaattgccctccctagtttccctctgtgtcaatgaagctccctctgaggcttcctcattctccccagggccagcctctctcagctggaggtgtgacctcctgggtttagactggggatggagcttttggaagatgtggggctgagctgcgaactcagagattctttgatggtagcaacagtggactgtggctatgagaatgggaggaatggaccttcctttcttccatacttctttgcagggttagaatcaggatttttttcctagtggaagtaggttgagttagctcacaaatctgggatatgggagaaagggaaagctcttggaagctcgttggaagaaagtgcatgtgcccaccattagtttagcagatggaaatgtatttgggcatgccctttcccacataaggtcaggggccagatgggatgagaatgtagagggtgtctgtgtgacctggagttgagaagcttttggctccgaggccaggaccacttgtgcctgctcccaccatggctgctctggaagcctctttctgggctggtaccatatcccatgactctcaccctggttccaaggaagggtggtcatggatatctgttctggaaccaccttcagtcttggccatctgccatttgcttggctttgcactttggaactggaacatatgtaagttatagttaagatctgatgatggaaacttctagaaataaggtccagcctgcagtgatattgtggataagatctattttactttggttgttctttactttcctattggtgacctcccatctgcaccccgaccgccaggagctgggccctcctgacttcgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtayggtggctttacccttgcccacgcctgagatgaggtgtcagaagcccgacattactttggtggggtaatttctctaacagaagagtgtggagatgaaggaggagacgagagaccatttcttatgttagaaggaggagctctgaggggcagacctgcgtgctgttctgctggggcctgttccagtgaagatggttcaggcgggaccctccttttgcacaggataaggggatctgtgctttaacagcttggtccttcatttcataaaataatgttaaaggcagctggcgtccctgacagcagcctggctgcgaatggcagctggaactcatagcatttgctctgagtcagtaggaactaacaggctttcttggcagagcaggagccttagagatcctgatagagagaatcgtgacatggtgtactgaggggaaaagcagtaacagggaaagccatgctgagttttagtgctgctctgccaaatgaagggggaccacagggattcttactstagagcaaagaagaccacgggattaaacagaggacccrattactttgtttcagggtattcctggagaagacggctaccgaggctatcctggtgatgagggtggacccgtaagtaaaaattgttttagtccctaaaatttcaccccctccttgatccttacccattgggattgcattgtggatttcatcatttgttcagttgctgatggctttccctttgggagaaaaattaatttatacttttcttaacaactttgcctggatgtctaagtacgataattgaagtatgacaaatgtgggcatgaagggtgggatttgttcttactctgtttcagaaggagggattaattggtttctgagccagagggacaccgaatttgcacacccagtatctactagattaagacatgcaagtagagatgggagtgagctgaggggcagggacacagcaggagacctcaccagggctttaggggttaccccgttaagggtagtccctggaggggatgttgctggatcagatcatcagtatccgagggtcttggggatggacagaccccagtagcagggtccatgggagcaatgcccaagacagacacctgtctggggagctttgggaccctagatcaaggtccagccctgggataggggacagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagcttgcaaaatgcctttgtctctcacaayagggtgagcgtggtccgcctggtgtgaayggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgagcagggtgggttcaggagcaggggctgcagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgcttctctgtttgctgaagtttgaaggcaggtgctgaagggaagggctgcaaagttacaaagtcagctccttgccctgggttttggggtccacccccgccggcccagggagccaagaccacccaagcattcagttctagttttagttttaaaacatcgcacgtggtggtgagagaggaatccaaaggggtaggactctaatattacattttcagacactgcaacattcaaatggggtggagtgggggaacagcccttggcctcttctgcccgagggaccagccctgcaggaaaagctaatgcttcccctatcgccttgccttctagggctctcggggattcccaggagagaaggtatgcaagcttggttttgttttacaaatggaaaactctcccagtatttctcatttcttcctttgccagaatagctttctatacttacctgtccgccttattccctcttagggcgaagtaggagaaattggactggatggtctggatggtgaagatgtaagtgattttactctaagtccaaactgcttttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaatagttattttctttcctcatatacatcaagcccgcttcctccaggcagccttccctgacctcccctgtgagtgcacccattacatcccctctcagctctgacacattacagtacattttcttgtttcgagatcacatcccatagggcagggactgagtttgttttgttataaataaatctccagtgcctggcacaaagtgggtccccaataaatattcatggatttactaaacgaatgaaaaatatgtggaagtgaatttgccttcatggtgaatgagtaaattgtaaacattgttctagttaagatttatgagttgaagaatgtgatttttagggtgagataaaaatggaaacatctagtttttagcatccacttgtgctttttctttagggtgataaaggacctcgaggagagaaaggagaaagaggagatgttgggattcgaggggacccggtaaagatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgttatacaaatatctgagaagtttccaaaaatgtggtatcagggcacttcaaatttgcttttggaaaagagaagagtttgcagcttttctcattttgtgtctctgtaaaacgtttaagcaaatgagcagtacaagctagcctcttcttccagtccatcctgcctctgtggccaaggataagcaggagtgagcctggggcatcctcctccctggggaagaacgattgcacctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttgctttcagggtaacccaggacaagacagccaggagagaggacccaaaggagaaaccggtgacctcggccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcagacgggctcttcctctgtgaatcgaccccttkccctgcaatgtcttgtgcagcatttcagagctagacattcttctctgcagatgagaatctcatgctaattttccccacaccagggtgtcccagggagagatggagtacctggaggacctggagaaactgggaagaatgtgagtgccattagggctttggggggctctgtgacaattcttagtgccataagatctgcccaacatgacctggtgcatggttagtccacagctctgcagtgagtgaatgtaaaaggatttctgaaacggttgttactccaatctattttcattcttataatttccctggtgcttcatctcttctctctccccaattcttgctctccccaaaaacatactgaacagatacttttaaaaataatatctttgctactttcaaatatcgggccaggtttgatccaactaaatatttaagaaacccaaatggaaatcctaatactgggggagggagggaataaggggcaagagggctgagggagttgtggatttgttgtttttgtaattatctgtgggtttttggggggatgctgtaagtgaaataaaaaaactagatttcttctttttctggcatattgcatcttgcaatttcaagacatttcagaaatgtctgtagcagaatagctccttgtatgcctaatcctcagtcttgttgaataaatgctaaagtcaaagtgatgtgaatgatctttctgaagccaaccaaaagcttccaaggtcctcgggcacagacagcatctgccttgtagctgggagaagaccagtggtgtagaagtttgtaacctctcagaggaaattcaggatgctggtgggtgcctaggggaggtctctgctcagaaatgaacagagcacaaaggctgcaagctggggctgggtgctgggaactgggccctcagccacgccctgaggggcagtggctcgttcggcccggcacttgggccagtagagttcgctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttgaataatgctatataatgaaaaagaagctatataatgaaaaagaagaaatactcatcaaatgttacaatgggctattacaactcagcgtgtgagcagagccaaaacttggtttcatgaaatgacttaaaattgagtagttcatacaattaatttcaattctacacacaaggtagaaactggatttgaattcggtttcagtcacgggctcttgaggactcagttcttccttttgtggtctaatggcctgctatcccttcccttaggaccacagtgccaggctcaggccaagctgaaatgtgtccctcccactgggcttcagcatgcctacatcccctttctagagtctccgcaggcggcctctggcctgagcaatgtatcactgagtgctgctggactctcatggaactctagcatgtctcttttgggaggggccaggccagattgttggtttgtagaggagaacagtgtccccttgtctcaaattttccatggaaggtggccaagatcttccgctgaagcaggtggcattacagcgaataatggcaaactggtcaccgcagatcactgggctggtccattggaagtggagagtgaggttcctaggttgatgtagcagatgactgagccccacaacagagctagtcggtcacagcctctgcaacaccaaccctaactttgcaaagaccgcctgggacattcataaagtcccaccccaaacctttctactgctgaggaaacaattttgaggtggaaattaatggattacttgtgaagtaagcccacatgtttgaactaaaggtcacctctggagcatccaggaagatgttgccaagtcgtgagccctacctaagtacacgagacgtttaggtgcacatgtgtgtgcttcagatattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgcagccaaaaggagtcattattttgcttggcaggtctgcagtaattctcaaaacttccattgggtgattaacaggagcagcaaggaagcaaaacttcacccggatgagggtggaggaagggtgtctgtgtgtgcgagtttccccagggctgatgaggtgtggtttctggttcttggcacgatgtgggtgcttgggaagattcccctgagtaaccgcagaataagagggtgaagtctgaaagagctctaggccccatgcccagcgtcccatgctccccctcacagtttgtgggactttttcttccacagggtggctttggccgaaggggaccccccggagctaaggtgagcctcatgcagtgccccctggagactctcttcaaacagcccagatgccgcccagcccaggagtgaaaaacactctctcctgtgaacccaaagcttcggagacagataccaatcaatttagaaagttgatttcgccaaggttaaagacatgcccgtgacacagcctcagaaggccctgatgacacctgcccaaggtgttcggggcacagcttggttttacacattttagggagacatgagacatcaatcaatatgtgtgagatgtacattggttcggtccagaaaggtgggacaactcgaggcaggggaggaggcttccaggtcataggtagataagagacaaaaggttgcattcttttgagtctctgattagcctttcactgaatacacagtttaccagaacagtcacctatgccttagttaggcttagtgaaaaacagggcgaaggaagcaattggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagttcgagactagcctgaccaatatggagaaaccccgtctctactaaaaatacaaaatagccaggcgtggtggtgcatgcttgtaagcttgtaatcccagctactcaggagcctgaggcaagagaatcacttgaacccgggaggcagaggttgcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttttccctggttgctttccaagtccctggcccagaaatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacaatgctgtgcaatcatcacctctatctaggttcaaaacacagtctcgaaggagacctgtacccattagcagtcactccccatcaccctccaccccgagtccctggcagccactaatctctctctctttatggatttgcccactatggatattttgtataaatggaatcatttactaggcagctttgtgtgtgtggcttgacggagcatcatgttcttgagcttcatccacattgcagcatgtagaagcacttcattcctttacatggtggaaggatactctgttgtgtggctacagcacactttgtttatccactcattggttgatggagatttaggttgttgccatcttctggcaattgtgaatgatgcttctgtgaagattctcctacacgtttttgtctgaatgcttgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtcttttccttcctcagggcccagctggtcctgctggtcctccagggctgataggagaacaaggcatttctggacctcgggtaagcctgtcctaataccagccccctctctagctgaacagagggcacattkycaagcaggctgagagagtttctcggatgatgctattgtagacagacctccctttagctctcctctttggcaacaaaaaccccagatttaacctcaggccttgcagtgactggctacttcaccccaagaaagtaagagtttccttttttggtgctccatgggcctctaagtctcaattctgctccttccaagtgtccctgggtggaaatcaggggatatgcctcaggatggaatcctggaaaatctaaatctaccaaaatgcttagattctgcaaggtgtttcacctttggtccctggagatagccccttgtgcttatgtattttgtatagtgagtgcctcaagttcacccatgagttcagcacagaagatggcccttaaacttgctgtgactgcagatgttatcttgcaatgcagctatcagcaatgatgagcagagacacactgtcattgctgggctaggatcaggtgtcacggaattacrtattcgggtttccctcatgkctgagatgatattgagggaggcatcctatcatttattaccaaaaaatgactaataaactggtaacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgagggtgtgaaaagggaggcagaataaagtcacataaaatctgggagcttgccgtcctgtcaggaacctaggatatgtacattaataactgcaacatgcattaatttgtgaaaactggcactgagaggtaatactcatgttttaaatttgtgcatgccatttctgtgcatgtttatatttgagtccgtagccccgtgctcagagctgagtgcttgggatttgcaggtgggacaggttccatgcccctggcgggctctgacttccatgcaggggagagtcaggtttcagagaccaatttgcctggacggttggccacttcactgacacattcctcccctcctgctccagggaagcggaggtgccgctggtgctcctggagaacgaggcagaaccggtccactgggaagaaaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatccctgccaccaaccatctctgctcagagggctggctttctcctggccacagccctccatcagctgccaggttttctgctcctctcttgcttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggctgcctgagaacctcctttctatcagctttgagataaattacaatttgtcataaccagtccgaaaagactgcatgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttccaaataaagatgagccttgcttcttgtattattggggatacggctggaaatactgaaacttgctcatctgcggcaaattaatttaacaagttttattttattggcaggggtagagaggtggggcgggccgtggggagagacattttttcccctgtgtttttcctgatacaagagaatgtagaggctaatgaagcttaaactaccttcatcttaggtcccgcaaatgctttgcaagcataactagatgaagcttttctgcaaagaagtaaatgtcatttgggttaaaatggaattggatttgattaggtctcagtccagatggaaacaatttcttttgaatgagacatcttaggaatagaaattattacctcagtaactcgttttttaaatgctatttaaaaatgccccaaaaactcaccaacaataattttgtaatgtacatttctacgttacaaaagaataaagaaatctacggtccattgtgactttttccaaaaggagtcatggcacctaacactgtataaaaggaccaggttgatctgactgttttaattccaagcatcaaaatatttttctgtctttcatttttgtcttttcaactaactgaagtttaaaaacgaatctgtttgtattacttttaatctcagaagcacagggaaaaaatcagacttcaaaccattgaaggaaatctcttcctgattctgtttctagtaatttgggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtgttggaaaggagggggtctaggggtgatgacttggaaggaagggaagggatatggggagggggaatatgacctgggcctgagagatggagttcagtgttttggttttgaagtagaatcaaagacttacggatgcatagaatcaaagtaaccatcaagattcctgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagtacgtatctgctgaggattatccaagygtccttgctgccagsaggctccaaggacaacttctgatgtgttgtgttttaaaagaattatttctttaaaaattgtctttgtatttgagtgagtgttttcktttgatgactcagcagacatttctttctttcaaggtcaatttattttasatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaatatcttggcattagtcttgggtcagccactcagttaactgggctaccctgagaaagacccttccttccctaaaatactctctcatctgtyaagtggaggtcataatacgtacttgtcctggtgtttatgagatttaaataaaatatgctgcaatcaaagtactctgtaagctgtgaaatgctataacctacatgatagtatcattactgattaattaaattaagaccatctgcaaataccacaaatatagtagtaacccactggaaaagtgaatcaaaactaaccacttggctgcccgggaaaagtgtgacccacacgtctcctggatgtcttaccccacggrccckcagtgagatcttctgttccaaagcttactgtgccacttctcggctttcttcccagggtaacccaggtgarcctgggctaaatggaacaacaggacccaaaggcatcagaggccgaagggtaagtttgcgtgggccttggctgcaggtgaggaatgagaacgtatgtctcaatgtgattaactgctgaggctttgacaattatccttcacttgcaccctggccagggatagcacagggtggaaggaagggaatcctgagccccagaccaatgtcctcagggtgccaccatggctgtggtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttctgaagcctctaggcttgcaagcgagccaggccaaggccatgggctcctcagactactggtgctgagattcctcttccttaagctacttttagccctgatagctcttttctttttattctttgtgtgtgtgtgtgtgtgacaaggtctcactctgttgccaaggtctcagtctgtcatctgggcggagtgcagtggtgccatcttggctcactgcaacctccatctcctgggatcaagcgatcctcccacctcagcctcccaaagtgctgggattacatgcatgagacaccacacctggccagattattcttcaatggatgtttactcaccctcttaaaatggcagagtcttcaattagcaaattgtggcctagatctgtgtaaatgttgctaacagttattttcagcctgaaatgtagtttaaaaagaaacataattatcttattaatttgatcagtgaagacagtcaaactagatcatttaatatcccaaagagctttaaaacattggatgattatctacactgaacgcattagctaattcactgtctgttacctattctcctgggagtccttagtaatcatattagtggttcttgggaaagcacctgtcttaccttagcctggcagagaacacaatatacaacacctctatagttggtgggggactcccattggctttgttgaggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggatagttggacagaagggagaccctggctacccaggmccagctgtaagtatttatccagttctgacccrgccacctggggctgggtgctttacacgtggtccctgaaaacttcccaccatctgctttgctcacaagaaaatgtgctctctttgtatttgcttggttgtcaaaccgcctctctgacatcatgatgcagcaaagagattttgaattttagagtaacaagaaactttaaaaaaataggtttcatgggatatcctgtcatctagggagtattgtaatttgcctttatagtttcctggcataggtgcatttgaggtttgtgtagaggagaaaccaaagaggggaaatctaaataccttttgcttgcatcttgtagaagcagtgtaattatgccaggccttggtttgacaatgcttcctgtggtctatgaaatccccaagggagctcctgatttgtggttaaatcccactagtcatgctgccaccaggagccaggagggcatcctcccacagcccttccaaacctctttattgctaatacctttgttttcttatttgaatttctccatatattgtccctcaatattgaaattggtgagtttcaaaaaataatggaaaagataattcaggagttggaaaatcattcctagaaggaaaggttcagggcttagtttggttgaattagggaaaagaaagctggtcaggtgggtctgattgctgtctttaagtaggtgaagtgttggggggagcacattaagccagttcctgcagaagaccaagcaggcagaaatagcctcctggaaagacaactaatggcccatgagatgcctgctgggctgtcagggtggtgaggtttaggcatgggacactgagggaagccacgagtcagtccctagagctcctcggggtggaattcagctgggatgctttagacacggagggagccagggcagctcaatgatctctcactgccccttcggcaggggacagcgtatcaagcgtgtgaaagggagctcttttctcaagagaagcagaatctagacccaggttcactcgtgggctttacatggattggtggtgagcttcctggtttcagaacatgagactatttcaaaggccaaatgacctcccagggaaacacatttgctccagaatcttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactccatcgatgtaagttgcatgtgtccagaatgactcattaacctcatgagcctttgatttgctctctttacatattcttttattttcttttaaagcaatgtgccctcatccaaagcatcaaagataaatgccgtaagtacatgattttctgttgtctcacaatgcatatttttacattcgaaattctcacatggtagagtagtctctcaccctttcttctctttgcttcttttctagcttgctgttacggtaagttgattttggtgactttctcctaaggaaaggaagcctcccttttgtagtaagtacartttrtctttaaccctccaccctctactttccacagggcccctggagtgccccgtcttcccaacagaactagcctttgctttagacacctctgagggagtcaaccaagacactttcggccggatgcgagatgtggtcttgagtattgtgaatgacctgaccattgctgagagcaactgcccacggggggcccgggtggctgtggtcacctacaacaacgaggtgaccacggagatccggtttgctgactccaagaggaagtcggtcctcctggacaagattaagaaccttcaggtggctctgacatccaaacagcagagtctggagactgccatgtcgtttgtggccaggaacacatttaagcgtgtgagraayggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcvcatagctcctaaaaygtccccaatgaggccatctgcctgagaacttctcttgtgaggtctccaggacaacctcgtggctccagcactacagggacgcctacatgcttgtagcactgcccccaggtccctcctcacatgttgacagctcttgccggttagtgatgctagtgttggtgacactctctatctactaacaaggtggtgtgacttgtttgctttattcatgaggacctggacgtttgcatccttcctgtctcctcccaagatggccccctgtgcacactctgagctgtgtcttactgtgtactgggcatttgcttcccataactggctggtgaggtttgtatcatcagtctcacctcatggataggaagatcctgctgttagtgaggtgctcgtgagaggctaggaccctagtccattagactctgaaacccatgtgctgatgatacccattccagtctccactctgtcccaatcggccctgaaggtgaatatccagggtggccctggaggcctgtagtctctcagtgaggtccccaaaactatgccgactcagcacccccaatytacaccacaccactgtgcaaagctttyttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctgaccacgtgatctgcctgcctcggcctcccaaagtgctggggttacaggcgtaagccaccgcacccagacaactagtttaattcttacatcaattaatatttattcagtgcagttctggcgatactgttcaagacagatgggtgatgggtaggaaggagtccacccgggagtcaggaggccttggcctggttccacactccccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacaggatgatttgtgcatagagcgctgggcttgggaattcagtgttgaagttgggctaccggccatgtgctcttgatggggggattcattcacataagtctgtccttgtgtgggctgagggacccagaaccacgtgagtttcttagcatggtttcaacgagatcaaaaaattgttcattcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaagttcctactatttgccagaggatacaccagttactaacatttattatctaatttaaccctccaaatgacaccattaggaaggtattaccccccattttacagctgaaaaaaactgaaacccatttgaacgggatatgaactccagctcaccctagtagaataaaacctatgtctttctattatactcagagcctaaccccacccccaaatgagaagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctggagaatgtcctcacgtgtcatgtttgcttgggtaagctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcggataattcattttataggtaacaaaggaggaggcagtttctgcttaagttttgacattagaatctagaatgaaaacattggcactagtgactttctagaacatatttcttcaaagagtggcagagaagtaatataatttttcatttcttttaaaaatgccagcacatggtatgctacaaagattttaggttagtgatttgtttcatctactaagtattaggtgatagaaactgaaatctggccataatcaaatcaaggcaagatataaattggttttggttgtgatgttttttttttttttttttttttttttttagacagagtcttgctcttgttgcccaggctggagtgcagtggcacaatcttggctcactgcaacctctgcttcctgggttcaagcgattctcctgcctcagcctccagagtagcctagattacaggcatgcgccatcaggcccagctaatttttgtatttttagtagagacagggtttcaccatgttggccaggatgatctcgatctcttgacctcgtgatccacctgcctcggcctcccaaagtgctgggattacaggcgtgagccaccgcttccggcccgcttttgatcttatgtgatcattttaatcgcccaagtctcccagcagattgatgagctgtgtatcctgctgtgggtgtcacagaacaaataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcrtacctggtcagacaactggacatgagcccagatcccaaggcctcccagcacttcgccagagtggcagttgtgcagcacgcgccctctgagtccgtggacaatgccagcatgccacctgtgaaggtggaattctccctgactgactatggctccaaggagaagctggtggacttcctcagcaggggaatgacacagttgcagggaaccagggccttrggcagtgccattgaatacaccatagagaatgtctttgaaagtgccccaaacccacgggacctgaaaattgtggtcctgatgctgacgggcgaggtgccggagcagcagctggaggaggcccagagagtcatcctgcaggccaaatgcaagggctacttcttcgtggtcctgggcattggcaggaaggtgaacatcaaggargtatacaccttcgccagtgagccaaacgacgtcttcttcaaattagtggacaagtccaccgagctcamcgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaaccgatgtgttgacaggaactgtttcattcattgaacagacatatattgacacctgccatatgccacaaatgcttttaggagccagagtaagcagggaacatgcagacagtatccttgttctcattgattcctttattccaccacatttgaccaagcgccacctagtcataaggcactcttggtgtccttaacagtttacaaatgggtgggcaaatggatcaaatgcacatttattacgcatgacataataggctggcatgtcgcgagagaagtgatttctgttaggggcaccggggaaagcttctagaaagagttgctttgatcggggcttagccaccagccccgtgcttggataccactgggtctttgctcatggggctccccctccctggaatgctctccaccgcacttcagcagcaaacccatattcatcttcaaagttcaattccaatggcttctgctcgccgtggaagctgctgctcccaaggcctgctcatggttaatccggacaccctatttagggcatctattacctggcctgttgatcatttatttgtgggtctgtggtcccctagactgctctttgaggaggtgcagcctattatagtttccagagcctgtgtacagtgtgcagcccagggtcagtacaggcaaggcttggaacagatgagggggatttataaagtataaataaacatgtatatgctaaatgtttattatttaaggcaatgttgaggtctatgaaaacagtattcacatttgtgaaggtctggcccccaaaagattcaaagaaaaatgtgaagcaaaggtaatcccccaggttcacccacaggtcactgttcctgtcttccaaagattaaaaacaaaagctttgttcaacaaagcattgagaaaatctgaaaagcagttgcattataatctgatgtccaagagtctagaacttgttgaactctccacttgatttttcttctatccctgtcttctctctcatgttggataaatatatctttaacttaatcacccaaatattgccaaatagaacatattggcttaccatgttttatggatccaatgccatcatactttatgtttaaaatcactggacatagtttgtctgatatagttaattcaacaataattatgggctaaataaatgttatgtgattcatttaacttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtcttaaaaattgtagcgctgcagggaatgcacaggtcctccaaccacctcctgactttatgggatgaggaccttgaaatccagaaaatgtgacttcccaaaggtaatgtgggtcatgcttctcaaataatctgttttatcagttagcttttgccatgtaacaagctacccaaaacttagtggcttaaaacaacaaccacctatttattttcttacttaatttatttagagacagagtcttgctgtgttgcccaggctggactgcagttgtgcaatcttggctcactgtaacctctgcctcctggattcaagcaattctcatgcttcagcctcccgagtagctgggactacaggtgcatgcagccatgcctggctaatttttgtatttttttttcagtagagatggggtttcgccatgttgtccagccttgtctagaactcctgaactcaaatgatctgcctgcctcagcctcccaaagtgctgggattataagcatgagccactgggcctggccaacaaccacttatttaatttgcaattctgtgggttagcaatttttgtttgggctcaactgggtggttcttctgttttctccttggatcccttatgtttgtggtcagctgcttgtcagctatagagctgctggtctagagtggtctcagatgggctggctcatctctgctccatgtggtctctcattctcagcaggctagcttgggtttgttcaccaggtgacctggcagggttccctgagagaagacaagtgtgcaaggcctcttgtgacctaggttagaactggcacactgttacttctgccacgttctattgaccaaagcatgtccaaaggctaacctagatttaagaatggaaaactaggcttgatggaaggacttgccacattacattgaaagggcatgggcagagagaaggtagataattgagaccatagttccaaacaatttaccgtatctggtgtgaaatgattacgtaaaagaaggattggatacatcaaaaaatagactccatgtcttcttaaaattattaatgctgtgataacatgtaatgatggtaataataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaactgagcccctgcagcgtgtcagcaatgtgtgctccttaagagaatgtcacagtgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttgacctcagaaggagtggctttaaatctcagcatagcaagaatgaatatcattgctaaggccactaggacccttatcgtggcactggatgcttcatttagctttgtagcctccatttttctaggctctaatgattcgtattttttctctgaaaccttccctgaaattggctcaacctttttatctttaggaaaacagaatgaatgaagtaacctagtatttgaagtcttatgatattaacttgaaaatatattaatacttcctaggacaagtagcaagatatgactataaaataatatattttcttctaagatcaagaaagctatgaagtgtgggtccttgttgttatgtctgtttgattaggctgctattctctctagatattggtaatagatcaagaaattgtaaaaaaaaatacacatacacaaaaattaagagaaataaaaaatatatatactcccagtaataagccctgggagcaaaatagtacatgctaactttataattttccagctcaacatagcatttgattgagtggatattttcttataatgtaagtagctaactactgatttcatttaatttttggtgtatgttttggttggttaattgctataatgagaacattgttggatattattcattattgtctcttattttctctctgcctttattttagaaattgaaagatgtttttgtagaacaatataagcttcatttttaatggttctatttttcaatatgctgttccatatctttttttagggaggcacagatccttaaaagaaggaatttaatatatgcactgctatacataatctataaaaactattgcatgcattttgctaaaacaaatttaatgtagctcatggggttatgtctttatttattttagatagcaggtaaaagtagaggtaatatttaatttgtcttaacagaaatgttccgaataacgttacttcaagtcctacatccaacccagtgacgacaacgaagccggtgactacgacgaagccggtgaccaccacaacaaagcctgtaaccaccacaacaaagcctgtgactattataaatcagccatctgtgaagccagccgctgcaaagccggcccctgcgaaacctgtggctgccaagcctgtggccacaaagayggccactgttagacccccagtggyggtgaagccagcaacrgnagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctcccactccccatcctgtgccctcaatcctgtcttgcggtagggatgggaagctstcattctctctggaatgtcagtgggggcacagytcacctcacctgaaaattgagttgtcttaaactaaagggaaaagtttccgtgttgaaataaggttttagctcctatttagggagtgagagagacagaaagaaaaacgctgcagttggttcttaggcagcaaggcagatgtttctgggctggtgtatggagccggactcgcctaccttagaacatgccttgaaaaggtctgggggagccctttgcaactgcaaactttgtctctgcctcatacccacagaaaaggggccctaagctgtgtgctgtggcaatactgggtgttcagtccagcagcttgaaaagtcagagcctggaccatcagtcattccccaaggctcaaatctatgctcatgctgaccatgagaaaaatattgaaagcaatggcaaaaaccacaatgactctgcaccaacttaatatatttcagactgaattagatacaaaaggtagatggctttaatgagaccaagagtatgttattttatcattttcctaaagaagatactggaagacactaccgaatgtcacaagctgtaaaggaaggctcatgataaaatggaaattatcttcatttgatgaacagtatgagagagaaagcagaattcctttaaaagaatttcatgtcataccctaaaattttatgacttaatatattttaaattatggggctcattttgtagcaaacacaacttaggattagtatgctgcatttccaaagtatcttcttaacaggcgagatttttaatagaaaaaaaagttgatgaataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatcttcacgctctgatctatctttcagttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacrgaccgygtcattggaggcctgctcgctgggcagacataccatgtggctgtggtctgctacctgaggtctcaggtcagagccayctaccayggaagtttcagtacaagtaagtacatgatcagtacaagtcggtacctgatttctatgtagagtatcaaayaggacacaaaggagacacttacttattgaatctattctgaaataaccacaaattcraaaaacaacaacagcarcaacaacaaaacaactcagcctgggtgctttggtggcagcctaagcttataaaacacagaatggaaatgggattccatgtgggatgcagtcctgccctctgggtcctgggctactttttggaggaagccagatccacgtcgcctgagcacagccctttccaacattgcacccgggaaagatggccacgtctcccggtgagggctcctggttgcccaccaccccgtccaggtttccatgttcaggaaaacaccagccagtcactggctccttagggagtaatggaggtgtccctgaagtctcaccgccccgggggtggaggatgtcgatagctgagtctccctgccctgatctcaccatagttgggctctgcccttggctggctgttgtccccaggggcccccccatttcactgaggcctgcacttgagtgctgtcacagcttttcttaattattcatggtcccctctctcatctttctaaattcttctgggttcccccctcccattcttcttgacccccactgctccaggaatgtgaagggaaggctcctcttttcttcaggccaatgctattcagatcaaggaaccagcttgaggaaagggaattcccaccagtgccatggattaggcccatagagatatgagtccaaagacccagtcaaccctagggctctattttcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttatatcagtcactaaggattcccaagccctcctgtttctgatttacctacgagttgcatatatttttcttttatagagaaatctcagcccccacctccacagccagcaaggtcagcttctagttcaaccatcaatctaatggtgagcacagaaccattggctctcactgaaacaggtgagttgtgaaactattaggtccattaatggcactaagaaaatacccatcttgattccaatttaacttcctgggttctaagtcttagcccaggcatgacttctatgggggaaaaggtccacgtcagctctgtgcagcccaacatcatcttattctgcataatcccaggtgtaaatggagtcttactttacctgtgatcagactcagtgaaaatttgatgggaggtgcttttggggctatcactagaattcacgtatccattagacatttctcctgtgcctcatactgggactcgagttgatttgtggtctgtgatgctgtgaagattggcgtttcatttactcagtgatttaatctaataaaaaaactgcttagaagaacacaagacaaatttggctggaatccatgaaatgcatgggtttggatctgacccatggggtgttctggtccggacatcctaagcacacaccccagcttagtgtgtgagtctgtgatactgtctctcatgtgcttgaaccccagagtgtgtgcatagtctatgctaagttagtgactggttaggtgtaattcaggaactgacagctgttacttgcttttgttcttgggcagtgaaactctgagagacctggaatctctcattcagcagaatgtggacttggcttgttcatcggtgagaaactgattattaaaatagttgataggctttgcttaagagtgttcagcaaagaatgatggtactaacataaaaaatggaaatgccatgggaatttagatataatactgttttatacacctgaagcaaaagctttctgctaactaggggacaattcattattttttggtgtatcgtctactgtcaggaggaggaaagcatttctcttcacaatgctcatttctgtaattgattttaaaggtgtttgttgagtgagcctgttaggcgaccccaccatggtgcttgagctcaaagagaagccacaaagaacacagtagattttccccaaaggtgtgggtcaggacagattcaactctaacttcaaagttgctgaaatctgtgtatgtcatttctcactcattggttaacttctccctgaatacagtgtgggaaatagaaaaattttagccaatttagtgcttcattgagagaaaaagacttggagtaaactagagatcagagatcaataatgagtaaactagacagcaagatttggggatgtttttgattctcttatgtgtggtccaaaagggacaagattgtataaacagtgcctagttcatataaacaacaatgtctttcagcaagggtctggctgggctgttttgtttttcttttcacatatatatatatatatatatatatatatatatatatatatatatatatatatatatatgtagagagagagagagagatggggggagagagttgtgaggttcagaattaagaaggtgcttttgatccagacctttaacactgagatcgcctgtctacctgtgataaagagaaaagagcttttgaaattggggcttgtgtttctttcaaggctgcaagtagttgatacagatgaatctaaataaaacctttctccttcatactaattggggcataaccctcagacccaggatgtgaatgtcctctcaccatttcatgtgtgtgtgtctgtgtatgtatgtgtgtacacatgcatatgtgtgttttccttcccagggtgaagacataaattaccttttttttttaaaaaaaaagaacaaggccctgcataattgatctctgatctcttaaacttaatgacttcatagtaacaaacaagcacttaacctgccttggcctgatgaatatatgttggtgtacacacagttatggcatttttgagagctctttttgaattactaggttggtgcgaaagcaattgcagttttgccactgacagtaatggcaacaactggaattactttcgcaccgacctaataaatgggacatttacttaaaaatgtctaaaattcaaaatggataaccagaattaggagaggaatccttatcctccccacccctaccaacctctctccctcccctcctcaccttctcctataattgtcattttaactatttcccctggggtggggggaaaattttttaatggtttttatatatttggatataggaaaaggagtgacaatgaaccactctttattaaataactaaaaaaagataataactgcatgcttactcagtagttgcatgtatattttgcatccaaattccaatgaccacgatatgcattatttctccaaatatacattttctagaccattcaggcaaaatgaagttttaaaaatatattttttatatttacatgtgtccattttcattcctcttactttctgcagcatccattaattagaaacatgtttacagagatgggtccctttcttagtattaaatagtagatgctactgtttgcttttttacttctgtgaataaaagatgctgtcttaagaatctgtatttttcatagtttatcatgttagattctgggaacctggtgacctgtgtttgaatctgtgaaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggttggggcattttttgtcctccataagatctggccctgtttggtatgtggcagggagactctcgcctttgagatgaaggttgattctgttaacaggccttgattccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacatctgctgcctgtaaatggcagtgagcagcagtggatctttcattcgttaccgtggscycctgaaagcatgggtgtgctgggcctttctgccacctgctttgtcgctgctgattttgacagtgctacgtagttgctaattttggtttcaggcttttgttaccacctccctcttctcccttctcatttttagctaaggaagctttggatagatattttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttattatttattcttgaaattagcaatctgtagaactgatcacattttgtccgagtagacatgactgggccaattgtatagccctgaaggaaccatcattttgtgtttactaacgttttacttattgattctaagatgcacaattttcttctcatggggacacttctgaaactgaaatgtgacttagaattgacaatatatcatggtttattggtagcattttgtgttacttagtggaacataaaataatggtgcatcataaaattaagagctcttatattggatacaatacagtatttggttggccatgttccatgtgaatatatatcatcaattagcataaaatggtatatttgggggaaatacctgactttatgttaataataatttaaagaacaaactaatcccacagctgaagtaagttaaatagctacagggatttaggaaatggtcctctccaggctgtctgttgttcatcgctgtgtgaggatgttttctggttagttgtcatgtgtgggttatgatgagcccaaaggagtgttttttatcttgaagtcttaaaaaatagaagtctgttggtcaagatctgaaagagtaaaatttaaccacagctacattttaaaataaagttaaaaattggccgggtgtgatggctcatgcctataatccctgcactttgggaggctgaggcaggaggatcacttgaggtcaggagttcaagaccagcctggccaacatggtgaaaccctgtctctactaaaaatgcaaaaattagccaagcatgatggctcatgcctgtaatccagctactgaggaggctgaggcaggagaatcacttgaacctgggaggcagaggttgcagtgagctgagatcataccacttcattccagcctgggcaacagagtgagactcagtctctaaataagtaaataaattaagtaagttaaaaatttggtaagtttccttggtaccctttgaactgaccaatgctcaaaatgtagacggcggaaagtgttttcattcaggcaaatcatacctgcatccaaggtatggaagtactttatactgtaacaacaatgccgagtgagaaggtgattgaattttcttgttttggggaccattaaactgatgaggaacatgttgatgattgcagcataaacacctctcagtctgtcttccttcagtttgctcaaggaagtacttacatcgtgatttggaaatcaatatgtttgggaaatgtcaaagctgatgcctttaaaaatgcattgaaacactatgggaatatcaaactatgaaaaagacaagattttccaatcaatatgttttccactttgaagaatacatatattttttgctgattataaagttaacagatatgcattgtcaagcattcaggaggtacagagaaatatattacacgattctcattgtgacagcattgctggcttttgatgaaaaccaatagtgacccgatgcatagccttcctatttttttctatgaatattattgcttgtgggaaggtgcatgcatcgcacatgcacatccactcctgcacatcattattacaaaaatggactgtggggcttagggtgccttgcgccccagtgtttttgaatggttgtttttaggatgttctaggtaggcacctgtggcttctgggaacaggtgggattcccagaacagggttttaacctaacattgtgcttgcctccgtttcctctcttctatttggttactttcctgaagcccagtgaccaatagtaaggaagtttcagcagacagtggtctgagtcaggcagcctttcccctctctgttttccaagcaaacttagttacattggtattctaggttaggaagccggggaaggttgtggataattttcagtccccattgtcttttaggctcccactaggttctcaataataaagaagagcaaattaaggaagactcagccatgcgctcctctcacataaagagaaggctctagcttcctacaggttatacctggggggcagactgatttcagagggaaaagatgaacaactattgcatccaaagacgtgtcgttctagggaaaagtccaggttaagttcaacgagggccagccatctcccttggtactccaggacatttaaatacttttttttttttttgctttaaaacagttgctttaacatatgcactcatagctgagtagagtccagccaaaacgacatgtctcagaagtcaagattatgtggagtttgcattagaagccttcttaagaacataaaatcctccgttttcatgcttcagaagtagagaagtacaggtttttgtctttgaatagtgccgggttctcacctcactaatatatttctcttggttttccaaatatcttcttgtccacagtaacagtgtccttattttccactagtaaatcttacagggtctcagtagtgactctcactgaaataagggcagaaaacaccagtgccgtggtgtggaactggagggctagggtggagggccaaggaagctggagaagccaatcagacggggagtggagtgtgctgctgtgaggccactcatgggctgggtgtccgtggctctgggcagacctctcgtgactggttcagcagagcccaggggactgggaattgaacagctaaacacagatggtcaggactgaagtgcacttgaaacaaataaaatagagcaaatagggtccattggccaacgctctgggaaggaaggaagaatagggagatcatttgacgccggcctcacgctaacagggaagccaccagtaaatgaggaataaattttgatggttaaattaccttgccttgtcagttctctccaggaccttccttgacagccaggcattttccttcagttattggcatatttgagagaaagaaggttgtttttgtaaattgtcttcattttattctgacttcctggagtcttcaaaggctctcgtggggaccactggctttctgggccctgagagcgtctgcaactaggaggtgttgtaactgtggagccaccagccaccagcctggaatttgggtgacagcagcaaccaggaaatgttttagaccaattctgagcctcagtcctgtgcacctttgagtctggtccatcgtgggtgatccaagctatgattatccactgaagacttaggttttccttgtcctttttggtatctatctgaagcacagatgctcaccacctccgcagctgtgagcagcctgcctcgctggggacaaaggagatggagaagcatctctttgtaggggagagctggataattccagcctgttagctactcacaggaacatgcagaattattggctccagggagttttggagaaagaaggtttacgttttcaaacttacagataacagttgacatcaatgcttctctttcccagaacaatctggagtttgccagaaaactctgtaaacaggagtcgtgctgtgtgtgaactgtaaactcttctctccaggcgtcgaggggacctttgctttactttgcagctgggctacatcagacgtgtgcattggaaacataaacttccttaactgggaaaagaatgcttctctgtcttcaaaatagttctgctatgtgacatttttgccatcatgaattttacatcagtgctagctctttgttttacgtgtttcatttggcaggtcacaaaggctcttggctaccacacatacgtgcatacacacacacacacacacacacacacactcataaaggattttcttttctgctttacctttaattttcagtctacttggcttgtaatgaaaggtagagccttatttttgaactatatcccaacagaatcgaatttccattttgccaagaattataaaaccctgaggttttaaaattcagtttcttttctggggatttaacatggaaggacttggagggcaaatggcccagtgattggaaaggggaaaaacaattcatttcatttaaaattattcaataaccattgccagcatttgggattctgagtgctgtttatgaagccctttcattgatataatttcatctatctctcacaaggctgtaagcaattcctatgtccatatggcagtgaggaaatggagatttgagcaggttaagggagttttcacctggaagctcttcttttttttccttctgccacagtagggtcatcagactgtcagccccagcactgggagccgagtaacacgcatgttctcattaatatccttttctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttgtgtttatggcttctgcaaataagagattcaggtcaataagtcaccttgaaaaatattagaagtgcaatgattatgatacatgtgaaaaagaagataaagtgtatcctcagataaggaagacgttcaaatacaacccatgaaatgtctttttgaattcctattttgggtttctaaaaacatattgtcccttgtcattcttcagaaatgttactaagttgctgttatttgtaaaatattgcaccaaaaatgattcctgggaagataatataatgaacaactacagataacgccaaagataaacaacccccacaaatttatcttttaaatagttttgcttcctataaataacaatgttgtcactggggccatccagtatctccattatattgtgcagttcaactggtaataaaataaacactttgaacagagcctggggtcagtgccagaatggggagagttcagttcgtataaaggcctggtagatggtgcagggcaaaagaatgggatcagatttcccagacatccctgggccccggggccccaggccaagaacgtcacagagggcctttgatggtactgagtagaaaagtgggacaggtgatggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttcatgctttgatttacactcgaactcgggagggaacatcctgctgcatgacctatcagtatggtgctaatgtgtctgtggaccctcgctctctgtctccaggcagttctctcgaatactttgaatgttgtgtaacagttagccactgctggtgtttatgtgaacattcctatcaatccaaattccctctggagtttcatgttatgcctgttgcaggcaaatgtaaagtctagaaaataatgcaaatgtcacggctactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttwaaaaagttgtaatagagaatatttttggcattcctctaatgttgtgtgttttttttttktgtgtgctggagggaggggatttaattttaattttaaaatgtttaggaaatttatacaaagaaactttttaataaagtatattgaaagtttcctgggtgtgacgttcttggcagtcttgtttccatagcagcgattgtcagaatcacccctaggctggggaaactgggtttggttctggccccatggagctgtgcaacagcctttcgtttccagtggaggaggcaaaagagctttatcagccagtgtgcaaagagaccggctggagacaagcatcccccgctttgtggattcagccccacatgctccagtgctccatggccgagcggaaggtgttcctgctgttgggtcccggcagtgtttctgattttcagagtcaggctggcttctatcttttcctctgactcttggttggccctcagagcctcagcctcctcctgtcttcctctccacagtgatcctttcccagggggttgatttgcttcctctcacaatggctgagagattcagtgttgccccacgacccccaaccccttttctggagtctcaaagcacaaggtctttcatttttttgtttttcttaaagactgtttttttctctcttcagaaataatacaagaaaccaacaaatacatattcaggtggcacttgagttccacttacaaaggaaacaacttattggataaaatacatatgtcctgacaagtgctgagggtagaattacaggaatcttgggtgtcagcagaaatgttttatgtaaaatcgggatgaatttgccagttggtctattgggaaaggagagaggagtgtggccctcttcagaagcgccacttagtccccacaaggtcgccatgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaagggatccctgcccccgccacccccattgacttgatctgctatggacctaaaatgagcatcacaatctggttttactttttgggttcctccggaagcagcccttaggactaaggatatgggtgtgagtagtttatttgggaggtgaaggaagtcactgagtggctgagaagtggggagtgagacaagcaaagggagagcactgttaagaggtgtatagtcagcgtccactgtgggtgcccagagcccaatccctcggggaaaccctgggaggtgcacctgtggcactgcacctcgtaggccagcagagggctgaaggagtttgggtagtcatacacctgtttccacgggtcactgaggcattcatgctctggtcctcttggcttgcaggcacactggcaaaggggccttctgtagtgtaagaaaatgttcttggcaaagacctgcagatactcccatgtggaacttgggggagtagtcaggcccaaggtacaggagtaggacaccaatatttgtaacatacctagatggtctgctcaaggtgtgttacaatagactggggcagggcccatcactaggagactcacttccaagggctccagaaccctctctccctttccacctcctgttgccagcatgcccatccctgccattcttggttcactctatctatgcattgcttctctgtgtgtgtcccttggctgctcaaggttgctgggacaatcacacccaccatctcacctgactcaggagaagcaggaagtgatgtaagtccaggtgagtggctggttaagctgtgtgtgctgctaacttagggtaaggcaaggtgctcaggtggtggatgggcagtttctcccatttattcccacagagcaaataaaacaaaatcctttgttacattgtctgtcctaacttagggttcagcaaaacatgatctgagctgcaggattcctgaccccttgacagctcgtggatttctcttcccaagacattcttctgccagactatgccaaggactctgtgtcctttcttgaaccctgacatgtccctgaccctcatatccactcagctctctctggggaagcctccagcctggcccgtggaaggtggcctgccaataaagaaaacctgttttggattttgtgactaagaaataaacttctattgaagtaagagactgaggtcttgggctgttctagcagctggtgtgaccgtaacgaacacagcgcacctttatccagaagcctttgtgggtcaggtgctgtactaggtgtttcacacacatcttaggtggtgccgttcagtagcggtcattgttccagttttaaagatgatgaaacagagggtcagagtggtccttttcacccagctatgttctaatggaggatctgggcaagttatggtgacccagaagccctctcagagttccaaggttggctcctgtgggacgctcactgccattctctagatgtttctggctctttctctggaagtcagatctaagccatgtgtcttttcccagaacaaagcatgccctccacatgaccctccccaagaccttccgtcactctttctcagacagcaagtctctatccttctccttcctttcattgtagtcttttccatctcttctcattatcctgagctgctctggcttaggaaagaacttggagaagctgggggctctggcacgcattgagggcttgcgcagaaggtggcctgggctgagtatggcctgcctgggctccaaggccgagtcacgaggacgtctatttgtgctcaactgtgagcacatctcaatcctttcaacagcagctttgctggatttttaaatacaagtgctttatactttcattccctcaacgattttctgcataattaaaaagaaatcacagcacttatgaatgggtgccaggctttttgtagaaagccaatgttttgaaccctcaagaaccattttaaatttctttccccatggtggttcatttttaggagatggttcgtattttcctgccaaatttccattgttgtcagatttccagctggacctagctgctcttcatgagccaggctctcagggttccacctatctgggtgtggcttccggagaagttggggactgctgacactgccaggccagggggcccagtccagaggctgccctctgccatacccctcctcggtttagtttgggtctgagctttgccgctgcctgtgcctccccttccctgggagatgaatactgatggtgagctgctgtaagagccatgggattcctggggtcttcctgctttcttggaatcatgctctccagctttgggccacccctcagcattcctgagatcccatgcagagccagttcagaaatccttttccgtggtattccctagtcttccacccaactttatggtgggtataaatctgctaaagaccaaaacaccaaagaagtagtattttggaatctagtagtcaaagcttgaaggcatttggtcatgagtgatgggaaaaggccagtgattcaagggcctctgtgcatgatggtgacaccacccaagtatcgctcaacctggaaaactgatattgttttcctgcctatgtcagatgtctctgtgaaaaccatgctgctgttgcaaaaagtcatctaagagaaggcatttgggcatctgcaaagggagctagctatgcatgtttgatttcaagagactagtaaattcccagcatttacatgaattttataagagatgttagaaacagaaatagcacaataaaaagaaattgtcagaacttgtatatctgggaaagaatatttgttttgaaagaccccatttaaaacagttacatttgataggagttgtagttgaagaagctgactggtcattcataaaccagtcttatgttgagttccccgaaagcagatcctgaccaagttttggctgcagtcatttgtttcggaaggtgtgtgggaagcacaaatgaggccactgagaagcaagacaaagaagttggcaagtcaagggatggtgcattaactaaaagcatgttacccttgagagcaactggggctcagtctccctggaaacccactgagaaagtggggagaatgctacgaggaacagaaagctggacgtttatggactgaccctcatctctctttggttggaggttgtagtagtcaccattatctagagggacaggactaataggatagacatatatatgaaagggagtttattaaggagtattgacttacacgatcacaagatgaagtcccacaataggccgtctgcaagctgaggagcaaggaagccagtctgagtcccaaaacctcaaaagtggggaagctggcagtgcagccttcagtgtgtgaccgaaggcccgagagcccctggcaaaccattggtgtaagtccaagagtccaaaagccgacgaacttggagtctgatgtatcagggcaggaagcatccagcacgggagaaagacgaaggcgggaagactcagccagtctagtccttccacgtttttctgcctgcttttttctggctgcactggcatcagattagatagtgcccaaacagactgaggtgggtctgcctctcccagtccactgactcaaatgttaatctcccttggcaacaccctcacagacacacccaggaacaatactttgtatccttcaatccggtcaagttgacactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatcagcaatcagccagtttgaacatgaacctatagaaattgaagtgtctttaacatgaagttgattagagagggttgcctagatgaggatgataatagagacatattgtccactcctgattactctgatggaaagaaatgaggtgatttatggattaagcacagcttctgagctcttaaactgtagcccacggtatgcccagccctctaccagatgggggtcagcaaacttctggtaaaggaccccaccagcgtccagtggttttggggctccagcaagagccatcgagcctgtgctgtgtctgtgaatttcagtggtggctcgggctgcccaactcccttgttcctttccatttgtggaactgaacctgatttgctagccttcccattgttgctataaactactcaatatttttccaataattcaattttcttcatatgttaaccagagtaagtttctgtcccttgctgcctagagcctggacaggtacacagtctttcattcaatcacttattcaacaaacatttgctgagcacctaacatgtgtcaggtattagacaaggcactggggatgcaggggtggggtggacagcacacatgtcttcctcttgtgttccttacacggcaagggaagtaggtggcaaacacacaaaaccctcggtaaataaggacgtgtgagctgcagtggaggctgtctgatgaggtactgcatgtttaaggcaagcctttctgaagagttgatttatgagctaaaaaaaaaaaaaaaaaaaaaaacccaagagaggccagcacggtggttcacgtctgtaatcccagcaccaagggagaccgaggcaggtggatcacttaggagttcaggaccagcctagccaacatggtgaaacctctctactaaaaatacaacaacaacaacaaaattagctgggcatggtggcacatgcttgtaatcctagctagtagggaggctgaggcaggagaattgcttgaacctgggagacagaggttgcagtgagccgagatcgcaccactgcactccagcctggtaacagaacaagactctgtctcaagaaacaaaaaacaaacaacaaaaaatcccaagacagccacctttgggaagacctgaaggaagattccagatccagagagggcctggatctgagatcctgggtagagaaatgactgtgacatgtttgagaaacagcaagatggccagtgtggctggagtcaaacaaataagcggataaatttttggagttgaagtctgagagagaatggccaagtcaggccccaaaactctttcataactaacgagttgtggattgtactttaatgtgatggaaagccattgggagctttaagccgggcagtcctgggtgtgacatgtgattctttgaggaggcggggtagtcaatcaaaaattctgccatgcgtattagaacttaggatgctattgaactttgaagcggtgatatgaggaagacagttgaagttcagaggagagggtggggctaaggatatacattcagcagtttggaaatataccatattcgaagcctagatttatggtgcgatttcattgcttgagagtatagatgaagagggacagggagtcaggagaggcctgtctgtgccctggcggttagaggttgagcagagaagacaggcttggtgaaagaggctgaggaggagtgtttgtagaaataagaagagaatcagtagagacaggtgtcatgcaaggacagcgttggcagaagctgtgtcaaaatgaacagagcagtcacctgtgctgaatgctgctcatggtttagaaaacagagagcaggaaggagagagtattcttggggctgtggtatgtagt

SEQ ID NO: 17698 - DNA, 55735 bp, Homo sapiens
  misc_feature (1)...(55735): n = A,T,C or G, or insertion/deletion polymorphism (see Tables 1-2)
ccccgtctctactaaaaatacaaaaaattagccgggcgtggtggctggtgcctgtcatcccagctacttgggaggctgaggcaggagaattgtttgaactcaggaggcggagtttgcagtgagccaagatcgcaccattgcactccagcctgggcgacagagcaagactccgtctcacaaataaataaataaataaaatttagaaaaataaattaaataaataaaagtaaagcgtccccagctgctgcagagtaaatgggctggtaaggaggaggctggggcagaggtgagggcagagatcacaggtgtggagagggaggataagctgggagattccaggcaggggcttggccagcaggtgaattctgggaatgagaggaaggaaggagtccagcctggaagcctggtggggccgtcacccaagcaaggctggggtagaagacacgggtatttgcaaaaataaaaatacagttcatcaggagttcgagatcagcctggccaacatggtgaaaccctgtctctactaaaaatataagaattagccaggtgcggtggcgggcgcctgtaatctcagctacttgggaggctgaggcaggagaattgctggaaccgggcagcggaggttgcagtgagccaagatcgtgccattgcactccagcccaggccgacaacagcgagactctgtctcaaaaaacaaaaacaaaaagtacagttcaagtgtactgagcgctcagtatgcgcagggcgctgggttaaggattgtttcctgggtgccacttgggacttccactccaagactagaaaggaggctgtaggctgtgcatctccagttgatagattaggaaccgaggctgggaggaggggttggacmttcccaggggccctgcagagctggaatcaaaacccactgctctccattttcccagggcgggagtctatagggccccagcttgtttctgctgagtgtaccagagggagaggagggaaagagccattgttgccaggcagatagattgattcagtcagtcaggtcaaggttaacttgaattaatcagtaatagggtggaagaaggggatggccttgctgtgggttctggagaaaaattctaggaaagcagccacctcagcctggaattagacgatgggataggggtttcccagctgctcccaggcctggctgcccctttgttggggaaggggagggatgggatataggggacagtgagtgaactcaggcaggtgtgagccgggggcatctgggtcccccacccagaaatcattcccacttccttcctcttattttctttctttttcctgtcttgctctgtcattcaggctggggggcagtggtgcagtcatagctcagtgcagcctctaactcctcctgcctcagcctcccgaggagctgggactgcaggcacgccaccatgccctgctaatttttttttttttcaattgtagagacgaagtctcactgtatttctcaggctggtctcgaactcctggactcaaacaatgctctcacctcggcctcccgaaagtgctgggattacaagcacgagccaccgcaccctggccccttctcattttccccttgcaccccagctaggattgccaaacagaatacaggacgctcagttacatttgaatttcagataaataacaactactttttcagtatatgtagcttccagataacccacgaatggtcagcccggttggccacactctccctccttgattccgggaatgctgggctgggtgggcctcaaaatggaaagtaccccaacacacacccagacctccttctctccctcccctgctggctcatccttgtgcactatccccctcccaaacctctggacaccaatgcacatctcccagaaaaaagtcacgaggttctgaagaattcccggtctcatctccctccctccttccctcccagtaggctaccatctgctccagcctccaaccccctcacttctcatcctgcccctcccctctggtcacttcttggaggtcagggtagggccagaccctttccaggttcaagtgattctcctgcttcagcctcccgagtagctgggattataggcacctgccaccatgctcagctaattttttgttgttgttgtttgttttgttttgttttgagacagagtctcgctcttgtcgcccaggctagagtgcagtggcacgatcttggctcactgcaacctccgcctcccaggttcaagtaattctcctgcctcggcctccccagtagctgggattacaggtgcccgccaccaatcctagttaatttttgtayttttagtagagatrgggtttcaccatgttggccaggctggtcttgaactcctgacctcaggtgatccacccatctcggccttccaaagtgctgggatgacaggtgtgagccaccatgcctagccagctaatttttgtattttttagtagaaacagggtttcaccatgttagccaggctggtctcgaacccccgacctccagcgatcccccagcctcagcctcccaaagtgctgggatgacaggcgtgagccaccacacctggcccctctgagcctggtggcttctaggcatcctggtttctttaattgtcacaacaaccagaactatcttcagtcgcattgtttagttggattaaccgaggctcagagaaaagaggaacccaggcttgccgctagacagaggccagacaggaattccttctcaaggttgtcaaaccacagtgccgaatgcttgagtctagaatgaaaccaggaaatggggtggcttgaggagaaagtgggggatagaagatggaatggggcaattgggagatccagtttctttcctttttttaatttttttttttttttttggcaacagggtctctctctgtcacccaggctggagtgcagtggtgcaatctcagctcactgcaacctctgcctcccggcttcaagcgattctcctgcctcagcctcctgagtrgctgggattacaggcacccaccaccacgcctggctaatttttgtactttcagtaaagacggggtttcaccatgttggccaggctggtctccaactcctggcctcaagtgatctgcctgcctcggcctcccaaagtgctgggattacagacgtgagccactgcgcctggcaaggggatgcagtttcaaaagctgaaccccaattctggagagcaagcaggtattttcattctctctcctcctcctcctcctcttccaaagagtgtgtcgcaatcagtgcagacagacgccaggtttgttctcatgctccacgcctccccctacccctggcacggaaaagaatgtggtttacaggaaatcagagaaaactccccattaaccccttcagtggggtttcagaaaccgcctctccagggataagggggccccacccacagacccttctcctgccctcaccatccacctcgtatgcctgggcagcaatgctgcagaacgtcagaggaatgccagttaaaatgacaccggctgccggggtgtggtggctcacttctataatcccagcactctgggaggccgaggtgggcggatcacctgaggtcaggagtttgagaccagcctggccaacatggcgaaaccctttctctactaaaaatacaaaaaataaaaaataaaagaaaaaaaaaattagccaggtgtagtggcgcatgcctgtgatcccagctctttgggaggctgaggcaggagaatcacttgaacccaggaggcagaggttgcagtgagctgagatggcgccactgcactccaccctgggtgacagcacaagactccatttaaaaaaacaaaacaaaacaaaaaaaatgacaccagggtaccagttttcacccataaggctggcaaaaatcttcaagttcatcaacatgcccttgtgatgaggctgtggaagaaactgacaattcatttcatgcagggctcataagtgtgtaaatcaatacaacttctgtgcaggggaatttggcaatatctagcaagattaccagtgcattcagagattgacccaacatatttcctttcattgcaacgacaactctatgaagcaggtggtaagggtttccttttccatgaacaaactgaggctcagggcggtaatcagtagcttacccaaagatcacagctagtttcagagctagaaaataacgcaggttcaagcttattcactgcagagagcctggtgtgaagccacagatgtcagtctctccatcaagaagaggctggtggctggacacagcggctcacgcctgtaattccaacactttgggaggccaaggtaggtgggtcacttgaagtcaggagttcaagaccagcctggccaacatggtgaaaccccttgtccactaaaaatacaaaaattgccagacgtggtggtgctcacctataatttcagccattccggaggctgaggcaggagaattgtttgaacccaggaggtggagggtgcagtgagctgagatagcgccactgccctccagcctgggtgacagggcaagactctaaaaaaaaaacwaacaaacaaaatatcccccaaaaagtaggaggctggttactttctcacaatataacaagaggcctgtaacctgtaagaatgaggaagttctttgctcactgaggtgaaatagcctctgaggtatattgttcatgaaaaaacgaaacaaaacgaaacccaagatttaactgaagagaccaggaagaatagtatgtgctatgtgctgtccacagggcacagtagttcacaccagcactttgtgaggctgctgcgggaggatcacttgagcccaggagttcaagactggactgggcaacatcgtgggacccccatctccacaaaaataaaaaaattatccgggcatggtggcggccacccgtagtcccggctacttgggtggttgagccaggatgatcacttgaccccaggaggttgaggctgcagtgagctgtgattgcaccactgcaatttagcctgagtgacagaatgaaaaaaaaatttttttaaaggaaaacacaaaaagaatatgctgtcaacagggatgggaggaagaccacctttactgctatacacatttgtaccttttagatgttgatcaatatgaatatattatacacacagacacacacacagacacacacacacacacaaacaatacaatttaatatcctaagaggatattgacattagacaggtacaaaagctctagaaatgaggactttcctcagtgatgacttttttcaccaccaaagtcactcaggcatcctgacaagggtaagtgaggggagcctccttggaaaataaactcacttggatagtgaactcctgcacatacctcaaagcccatctgaaatgtcccctcctacaggaagttttccctgaccctccaagaagcagagttctatttcactggggaaaacatttcttcttcttcttttttttccctgccctgcacatgagctagaaaacatttcatgaaactgggagtttctgtgctgggctctgtccctcccccattctacttcccctccctcagcatggaagcctctggaagtggggctctgactcccagcctacagagagattcctaggaagtgttcgactgataaacgcatggccaaaagtgaactggggatgaggtccaagacatctgcggtggggggttctccagaccttagtgttcttccactacaaagtgggtccaacagagaaaggtctgtgttcaccaggtggccctgaccctgggagagtccagggcagggtgcagctgcattcatgctgctggggaacatgccctcaggttactcaccccatggacatgttggccccagggactgaaaagcttaggaaatggtattgagaaatctggggcagccccaaaaggggagaggccatggggagaagggggggctgagtgggggaaaggcaggagccagataaaaagccagctccagcaggcgctgctcactcctccccatcctctccctctgtccctctgtscctctgaccctgcactgtcccagcaccatgggacccacctcaggtcccagcctgctgctcctgctactaacccacctccccctggctctggggagtcccatgtgagtggttatgactctacccacaaacagggctggttctggggtggaagcagacatttgggggtccaggtccctgtagaattcagggtgcatttgggtgtttgtggattcaggggttagcaggttgggaatgattatatatatttgggctgcctgtgagtttgggtgtttgtggttgggtgtttgtggaatccaggtatcatggaattggagtttatatacatttgggctgcctgtgagtttgggtgtttgtggttgggtgtttgtggaatccaggtatcgtggaattggagtttatatacatttgggctgcctgagagtttgggtgtttatgggttgggtgtttgtggaatccaggtatggtggaattggagtttgggatgtttctagaattgaggtcatctgttggtttagggtgtatgtggtgttcattgatggtgcggttgggggtgtttggagactcggaggtttggactttacaagatttgggagtttgcagcttggggacttgcaattttcagtgtgggtttaaagattggctacttcgggttcatgtatagttggggcatttggaattgattgtatttattaggactggggtgttggaggtttaggctgggtttggggtgctctaagatttgaggtttagaggttttggcgtatgtgggtttgggtaggtagagttgagggtgtccgggagtttgagtgtttacatatttggagtgtttagagaggtagaggtttagggtttggggcatgtgtgggtttaggcgattgtgggtctggaagtccagagacttggaggagttgctgacgctggttggaaggttcagggtttggtgggatgtgtggccccctcgytgcccaggctttcaaaggccaggcccagctggctgagartgggagtcatggtggctgctgtcctgcccatgtggttgagacggtggcagtgcccagagaagataatggcattggcaagtgcgccggcagtcactggatcctctccaggaccagaggctggggcacacagcctgccaggcgctgactccagtgaggactggcgtctcacatccgtggaatgacaagcccactcccgtgccccactccgacaggtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacggtgagtgcagactggcgcaggacccggctgacacccacagccacgcccactccccccctcctcctgagcccctccccttctgtcttctccctttctaagccctgcccttccctgagactccaccccttcggagtcgcctctccttctaagcccctcccttctctgagactccaccccttctgagtctcctccccttataagcccctcccttttctgagaccccccccaccccttctgaatctcctccccttctaagccctgaccttccctgagaccccaccccttctgagactcctccccttctgagtccctcccttccctgagaccccaccccttctgagrctcctccccttctaagtccctcccttccctgagaccccaccccttctgaggttcctccccttctctgagactccaccccttctgagtctcctccccctctaagtccctcccactgaattccttttccaagcccctccccctcgaagtctcctcttctgaatctcctccccttctaagccctgaccttccctgagaccccaccccttctgagactcctccccttctgagtccctcccttccctgagaccccaccccttctgagactcctccccttctgagtccctcccttccctgagaccccaccccttctgaggttcctccccttctctgagactccaccccttctgagtctcctccccctctaagtccctcccactgaattccttttccaagcccctccccctcgaagtctcctcttctgannnnnnnnnnnnnnnnnnnnctccccttctgtcttctccctttctaagccctgcccttccctgagactccaccccttcggagtcgcctctccttctaagcccctcccttctctgagactccaccccttctgaatctcctccccttctaagccctgccttttctgagacccccccaccccttctgagactcctccccttctgagtccctgaccttccctgagaccccaccccttctgagactcctccccttctgagtccctcccttccctgagaccccaccccttctgaggytcctccccttctctgagacyccaccccttctgagtctcctccccctctaagtccctcccactgaattccttttccaagcccctccccctcgaagtctcctcttctgaactcctcccctcttagtctccatcactttctaagttccctcacctgagtccctccccctttctgagcccctcccatgtsagccccttccctttctgagtccccgccccttctgagcccctcctcctataagctctctcctccttgtgagctcttstttttgagttccctccctggtcccccctctcccctcgcacctccttcacatgcccctccctccccaaaacggccacctcggragaccaagaataatgggcaggcaaggagggacccagcccaagatccggaagctggaccgtgggcatggggccttggaacagacccctgacaatgccctgcccacgcctagatcccagccaacagggagttcaagtcagaaaaggggsgcaacaagttcgtgaccgtgcaggccaccttcgggacccaagtggtggagaaggtggtgctggtcagcctgcagagcgggtacctcttcatccagacagacaagaccatctacacccctggctccacaggtgaggctgggggcggctggagagggcggggcaccrgcgtgggcgggctagggtctcacgaggcctctttgtctctccccagttctctatcggatcttcaccgtcaaccacaagctgctacccgtgggccggacggtcatggtcaacattgaggtgccagccagagggggccccaggggmagcaggggcacaggcttaggagaggcaaagagatcgagagagacagagaaagacacaccggaaggggtgcagtggcagagacacagaggcaaagagatatgcagacacacacccacacaacacacacacatacagcacacaacrtgcacacacacagcacacaatacacacacagaggcaaagagatatgcagacacatgtgcacacacaatgcacacacacaatgcaacacacacaaacacacaacatacacgaccacacaacacacacaacacaacacacaacacaatacacacagcacaacgtgcatgaccacaccacacacaacacacaacacacacaacacaatacacaacatacacaaccacrcaatacacacaaaacacacacaacacaacacaacatacataaccacaccacacacaacacacaaccacacaacactatcacacamcacacacaaacacacacaacacacamcacacacaacacacacaaaacacaacacacacacaacatacacaaccacacaacacacaaccacacaacatacacgaccacacaacacagtgcacacaaacatagcacacacaacacacaacccaacacacaaccacacaatacaccatatggcgcgcacacacacacacacacacacaggctgagagacaaggtggagatccagggagaccccagggagcagtgcaggtgtccgtggattctgctttcagttaaacccctgatcacttcacctccctgagcctcagttaccttatctgaatatcgggatcatgacggataattgtatgtcatctattctaccgacggcagccagaggacgcctgtgagcacctgagtcagggcccatccctgctctgcctacagccctccatggctcccaccttcctatgcgtcaaagcccaagtcctccctgcagtccacaaggccctgcacaccttgccctgtcccttccctgccctcccctcctccctctctccccctcgttcactcttctggagccacacgggccatcctccctgttcctccaacacccaggtgcagtcctgccttggcgccttggcacgggctgtgccctcttctcaagaaaaccctcttcttccaaatatccacacagcttgttctctctcctcctttaagtctttgctcaaatgtcaccaatgtctcaattttacaatgaggtctctctgagtaacctataaagtcgcaaatacccaccctgagcgtcccccctccccgctacacacactcctccttcctgccatgtcctgcaaatgagatttattcatttgataattgcttctcccatcgcctcgccctctattgaacctaaatccctccaggaaggaattgttatgtttgttgagggttttgtcacctgaactcagcacaatgctggtatatagttgggtttaataaaaaacttactggaagaagcgagaaggatgggaggagagaaggggaaggagggtgttctcatagaattatcatgaggatgtgttgaaatcatacaaggctaggtgcagtggctcacacttgtaatcccagctgtttgggaggccaaggcgggaggatcgcttgagcccaagagtccaagaccagcctgggcaacacagccagaccctgtctctacaaaaaagaaaagttaaaaacaaacaaaaaaacagctgtgtgtggtggtgcttgcttgtggttgcagctaccccaggaggctgaggcaggaggatcacttgagcccaggaattccaggctgcagtgagccgtgatcgcaccactgcactccagcctgggtggcagagtgagaccctgtctcaaaaaataattggggcaaatgcaatggctcaagcctgtaattccaacatttcgggaggcagaggtgggaagactgctcgaggccaagagttcaagaccagcctgggaaagctagggagactacatctctacaaaaaaaatgtaaaaattatctagatttagggattgatgtggtctgtggggaacagagaccacacatctcttgtaaaggcacaacagttgcccagctccaattagatgtctcctgctaaccagagtacactatccacagaaatttccttgtttccaacagaagctagaaaaacagatttttggccaggtgcagtggctcactcctataatcccagcactttgggaggtggaggcgggcagatcacgaggtcaggagatcgagaccatcctggctaacacggtgaaaccccgtctttattaaaagtacaaaaaaaaaattagctgggcgtggtggcgggcacctgtagtcccagctactcgagaggctgaggcaggagaatggtgtgaacccgggaggcggagcctgcagtgagccgagatctcgccattacactccagcctgggcgacagagcaagactccgtctcaaaaaaaaaaamamaaaaaacaaaaaaaaaacagatttttatatgttttaattcctaaagccagctcacggccttcagatatgccacttgcctgatccctgttacctctgtacaatttcttttaaacttatttattcattcattcattcattattattatttttgagacagggtctcattctgttgcccaggctagagtgcagtggcacaatcacagctcactgcagcattgacctcctgggcccaagctgtcctcctgtctcagcctcctgggtagctgggaccacagacgtgcgccaccacatccagctaattttaaaaaatttttgtagagatggagtctccctacatttcccaggctggtcttgaacccttgaccttgagcaatcttcccacttctgcctctcaaagtgctgggattacaggcttgagccattgmgctcgccctaatacattattttttgagatggggtctcgctctttcacccagactggagtgcagtggtgcaatgatgtctcatgatgtttaaatgttggcagcaaatgaaatgacactactagttattagtattcagagagacactgaaaaaatgagcccctactcatatgaactatgtcccaagccaacacagtaggtgccattataatctcctgtttcaagatttgcacattgagcacagagaggttaggtaacttgcccagggtcacacagcttgtaagtggcacagtagagattgaaacctaaggttgactgactccggtccttgttctttttttcgagacagactctcactctgtctcccaggctggagtgcagtggagtgatcttggctctctgcaatctccgcctcccgggttcaagcgattctcccgcctcagcctcctgagtagctgggattacgggtgcctaccaccatgcctggctaatttttgtatttttagtagagacagggtttcatcacgttggccaggctggtcttgaactcctgacctcaggtgatctgccygcctcagcctcccagagtgctgggatgacaggcgtgagccgctgcgcccacctgggtccctgttcttaaccacagtagacactgtgcacagagaatgtccagacacaggtcggggagagctgagaggctaagcccagcctccgaagagccactttatcctctatccttccctcctgcctcccacagaacccggaaggcatcccggtcaagcaggactccttgtcttctcagaaccagcttggcgtcttgcccttgtcttgggacattccggaactcgtcaagtatgtcaggttcttgaggagggggctcagggctcccctatccccggagagggagcaggggggctccgaggcctgagagaccactcatcygccctcctcacagcatgggccagtggaagatccgagcctactatgaaaactcaccacagcaggtcttctccactgagtttgaggtgaaggagtacggtaagaggaggaggggctggggggagtcagtgcccagaacgcctggcccagcgccggccccaccaacgccatctctcccccagtgctgcccagtttcgaggtcatagtggagcctacagagaaattctactacatctataaygagaagggcctggaggtcaccatcaccgccaggtgagggactgggggtggggccaggtaagagccaggtgagggaccaggtgaagaccaggtgggggactgggggtggagtcaggtggggggctggagatgggaccasgtggggggctgggggtggagtcaggtggggggctgggggtggggaaggtggggggctgggggtggggcaaggtgaggggctgggggtgggaccaggtggggggctggggggtggagtcaggtgggggctgggagtggggaaggtggggggctgggggtggggccaggtgaggggctggaggtgggaccatgtggggggtgggagtggggcaaggtggggggctgggggtggggccaggtgaggggctggaggtggggccaggtgagaggccagcagtgggttgggggctccagtcttcagcacaggcaggagaagctgggggagatcccattctccaggagggatggacctgaagccctccttgtctgtcccgtaggttcctctaygggaagaaagtggagggaactgcctttgtcatcttcgggatccaggatggcgaacagaggatttccctgcctgaatccctcaagcgcattccggtaccatagacggaggccgctttgatccctgccccagtccccgccacctctgagcccgctcccctctctgagccctcctctcccttctcagattgaggatggctcgggggaggttgtgctgagccgraaggtactgctggacggggtgcagaaccyccgagcagaagacctggtggggaagtctttgtacgtgtctgccaccgtcatcttgcactcaggtgaggcccagtctgaaggccaggstcaggaccaccaagtgggccggtctgagaggggagaccaggtcagaagagaaagcctagtctaaggagggaggctcagagtgaaagtggggttcagtctgatggggtaggcccagtctgagaggggaggccgagtatgaagatggattccagcctgatggggggaggcagggccagtataaaggtggggtccgggctgatgggggcacaggcccagtatgaagtctgtgtccagtctgatgagggaggcagggccagtataaagatgggtccagtctgatgggggaggcagggccagtataaaggtggggtccggtctgatgggggtcacaggcccagtatgaagtctgtgccagtctgatggaggaggcaaggccagtataaaggtggagtccagtctgatggggggcacaggcccagtatgaaagtggactctactctgagggaggaggtctagtctgaagttggggtccattctgagggaggaggtctaatcctgaggggtggcccagaagcctacactcacagctggtcccctcaggcagtgacatggtgcaggcagagcgcagcgggatccccatcgtgacctctccctaccagatccacttcaccaagacacccaagtacttcaaaccaggaatgccctttgacctcatggtgagacccggggcgggaaggggtcccactcctcccttcggggacaccggccacagccctgagcctgcctgaacttcccccacctgcaccccacatcacaggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgtctgggcccagcctcggaaccccatcactgggaagacggtacaggggttctggtgtttgcacagtggggtcctgtcatttgcatacagatattctcatctgcatagagaggttctctcctgcgcagaggggtcctgccatttgcatagagatactctcatctgcatagaggggttctgtcctgcacagtggggtcctgccatttgcatagacattctcatttgcctagaggggttctgtcctgcacagtggggtcctgccgtctgcatggaggggtccgcagtttgaggaaacaggaatcttccycttgcatgccctgctccttccacttacacggagaggcgctccatccacgcacagtctttccactcccatgggggaaggagcctgaatctcacaaggagggttgtgtagtgtttgggacaggcccattgttgtgaggtggtctcagttctcctggcttctgtgcacgtggctctgttgcccctcactgggagggaagcaagtctcatgacagctgcggaggttgcagatggcctcccagtccctctgcagctcccaggctgcgcaccccwcttacccctccctgtgctcagcatgtgcgtgaatttccggtggctaccatgagaaatggccacagcctagtgatctaaagcaacacacatttatgggtctatagtttgagaggtcagaagtcctggctctgggggaaagttcgctcccttgctttttccagtgtcgccagggcaccctaaaggcytggctcatggccccttcctccacctttaaaggcagcagcatagcatcttccagtgtctctctttctctctgtctctgtctctcctttctcccctgcccctgcttaataaagacccttatgattacattagctccacctacataatccaggataatgattccatctccagatccctaacttaatcccatctgcaaagccccttttgttaagaaaggccaccaattcccaggtctcagggattcgggtgtgggtatcctcgggcggcgaccagcaggcatccctctttccccacccaggtgcgcacgaagaagcaggagctctcggaggcagagcaggctaccaggaccatgcaggctctgccctacagcaccgtgggcaactccaacaattacctgcatctctcagtgctacgtacagagctcagacccggggasaccctcaacgtcaacttcctcctgcgaatggaccgcgcccacgaggccaagatccgctactacacctacctggtccgtggccacctggaaacctcagcccccgcctcctccttgtttcttcygcacccctgggactccttcccccatcccggatccctccctgcgttccctgccactcaccctccccagcctgatgccagcctgtccccccagatcatgaacaagggcaggctgttgaaggcgggacgccaggtgcgagagcccggccaggacctggtggtgctgccmctgtccatcaccaccgacttcatcccttccttccgcctggtggcgtactacacgctgatcggtgccagcggccagagggaggtggtggccgactccgtktgggtggacgtcaaggactcctgcgtgggctcggtaagtgtgccctgggctcgctcgccccctctccctctccctactcctctctctctctctctctccctgtctcctctytctctctctctccctttctccttttctctctcctttctctctcttctcttcctctccctttctctcctccctctctgtctctcaactgtctctctttttatctctctttccctctctctacatctctctttccctctctctttatttctctttccttctctctctccctctctcgatctctctttctctccatctctctccttttctctctccctctctctctccttttctctctccctgtctctttccctttccctctctctcccctctctttctctccctctctctttccctctccctctctctctccctttctctctctccctctctctccttctctctccctctttctctccttctctctttccctctctctctccctctctctttccctctctctccctctccctttctctccttctttccctttccctctctcccccctcactctccctctctctgtctctccgtctctctccctctctccctgtctctccgtctctctccctgtctctccctttctctctctctcccgccctctctccctctctctccctccctctctccctttctctctctctccctctctctccccctccccagccccacggctccccccaacctttctgtctttccactctagcccagcacccactccatcccaggcactcctctctcccagggctgacttctttcggcgtctccaccctccccacagctggtrgtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacrcagagtaaggtaagggccagtgacccaaggctgctgagaagaggcggaggcacggagctggggctgggggaggtgggtgggactggagagggcagtgcagtggggggcatgcgctgaaagcagagatcggagcagaccagacacagggatggttgaagctgaagatgggaatgaggttggacatgggttccaattggggatggtcctgagaattggacttttttttctgtttgtttgtttgtttttgagacagagtctctctctgtcaccaggctggagtgcagtggcacaatctcggctcactgcaacctctgcctcccaggttcaagcgattctcctgcctcagcttccctagtagctgggactacaggtgcccatcaccacgcccagctaatttttgtatttttagtgaagacgggggtttcaccatgttggccaggatggtctcgatctcttggccttgtgatccacccgcctcgacctcccaaagtgttgggattacaggcgtgagccactgcgcccggctgagaattggacactttcaactggggccctgagaggctggtggcagcacacccagggtcattcagtggggaaggtttccggagtagggacgaagatggagatggggttggcttgggatcaggagtgagratgggaatgcagatggaatcagaggggaaatggagataagatttggaatggaggccaggtgcggtggctcacgtctggaatcccagcactttgggaggtcaaggtgggaggatcacttgaggccaggagttcagaccagcttgggcaacatggcaagaccccatctctacagaaaaaattttaaaatagctgggcatgatggcgcatgcctgtagtcccatctgctcaggaggcagaggtgcgaggattgcttgagcccaggaatttgaggctgcagtgagctatgcctgcaccactgcactccagcctgggagacagtggaaaatcccaacttaaaaaaaaaaaaaagaatggaaagaaaggaggaaaaaaaaagaagagagagagaaacagagagaaagaaaaagaaaggagataaagaggaagggagggagggagtgaagaatgaaggaaggaaagaagsaaggaaggaaggagggaaggagggaaggaaagggggagcaaaggaaggaggaaaggaggaatggagggaggaagggagggagaggaaggaagggaaagaaagaagacagaaagaaaagaaaaagaaggccgggcatggtggctcactcctgtaatccctttgggaggccaagcactttgggaggccaagacaggcgaatcatttcaggtcaggagttcgagaccagcctggccaacatggtgaaatcccgtctctactaaatatacaaaaattagctgggcatggtggcatgcacctgtagtcccagatactcgggaggctgaggcaggaaaattgcctgaacctgggagttggaggttacagtgagcggagatcacaccactgcactccagcctgggtgacagagcaagactccatctcgaaagaaagaaagagagtgagaaagagaaagaaaaagagaaggaaggagagagagagaaggaaggaaggaaagagaaagagaaaggaagggcagaagcaggaatgggggagatgagagtgggacagggtggggtcatttgggaagagatacacaggtgcatatgtgggggatcccaattgtcagcctggcctccctgcgtcccgccacccctatgccccccgcagatctgggacgtggtggagaaggcagacatcggctgcaccccgggcagtgggaaggattacgccggtgtcttctccgacgcagggctgaccttcacgagcagcagtggccagcagaccgcccagagggcaggtgaggtcgccaccaggggccggtgcagggacagacagcacctccacctcccagatgctgggagcagagctctggaaaccgggggcctgggttcaagccccgcctccaccaccacctagtaaatccctcccctctgarcytcagtttgctcttccatcaaatgggagcaggaacacccccacctcacacgatcgtgaggggtgaaccgaggacacctagtaggtgcctcatccatcttcttctcggtccgcctgccctgcagaacttcagtgcccgcagccagccgcccgccgacgccgttccgtgcagctcacggagaagcgaatggacaaaggtgggagcctttcctacccactcctgcccccgagccccaccccaggagaccccagcccggccgtgcaggagccagagagggaggaggggaggccctggcggcggggaagtcctccctggggtccgtcccgcgtccctcctgctgccggcccccggctgagggtgtggcctgggggaacacgtgctcccgcagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaggtcccacggggtggggacagggggagggggccgtctgatgggggaggagactcctgtctgaggagggaggatgccctgtctggtgggggtggggctggaggaggccgctgtctgargggggaggaggcccctgtctgagggggcaggaggtccctgtctcaggggggaggaggcccctgtctgaggagggaggaaasstccgtctgaggagggaggaggtccctgtctgaggagggaggaggccttgaggggggaggaggtccccgtctgaggagggaggaggcctctgtctgaggagagaggaggtacctgtctgaggggggaggaggcctctgtctgaggggggaggatgcccctgtctgagggggtaggaggaggcctctgtctcggggggaggagtcccctgtctgaggagggaggaggcctctgtctgaggggggaggatgccgctgtctgagagggtaggaggaggcctctgtctgttgggagaggaggcccctgtctgagggtgatgccgatgaggtgatgccctgccagcgtgaggtagagaagacccaggtctgaagaggggaggatcaagtcagagaagcgtagatgcccatctgagatggaggaggctcccgtccgaggggaggggacactcctgtctggaagggacagaggccttcagatgaggagccaggaggcccaggcctgagggaggagaagggcctagtctgatggggagaagggcccttgcctgaaggcagagcagtttcctgcctgggaaggtcatcccagccccrcccatcagtctgaattggacatcaccagtgcccaggacattggaggtctgagggaaaagtctagaaagatgatggggctggtcacacactaattaccaatgggaaagctaaggtgagttccaagtttggcttcaccagagaaaactaatttgtgtggcattccagaaagacctgccaaactcgatgagtgaacaggcagcccttcttcattcatgcatgcattcagtttttgaatcaggtgagactttagatctcaygtgaaataagtcttaagtgaaacaaagagaaatttatcttataataagagaaaattggccgggcatggtggctcacaccggcaatcgcagcactttgggaggccgaggtggatggatcacttgaggtcaggagttcaagactagtctggccaacatggtgaaaccccgtctctactaaaaatgcaaaaatagcctggcgagctggcaggcgcctgtaatcccagctactcaggaggctgaggtgggagaatcgcttgaacctggtaggtttaggttgcagtgagctgagattgtgccactgcactccagcctgggcaacagagcaagactccgtctcaaaaacaaaacaaaacaaaacaaaaaaagaaaggaaaaagaaaattggccgggcacggtggctcacacctgtaatgcccacactttgcgaggccgagaagggtggattgcttgagtccagaaatttgagaccagcctgggcaacatggcagaaccccatatctacaaaaataaaataaaataattagccgggtgtgggggtgcacacctgtagtcccagctactcaggaggctgaggtgggaggatcgtttgaacccaggagatggaggcgtcaatgagccaaaatcacaccaccgcactccagcctgggcaacagagcaagaccctgtctcaaaaaagaaaaaaaaaaaaagagagagaaaagaaaagaaaatgaaaagaaaaaattcaagcaaatttagaatgatctccttcacaaagaggcgatagtgtgagggtcactgggaaaattagacaaaaagtctggtctactgaaatatggtttacatccacatggatggtgggctgtacttttctccagaattgtgtaattcctttggcccattgggggtcagaaaaagaatggctaaatgttactatcccaagacacttggattgattattccagagtgtgagtaaattcaggtatctcttttaggaattccatctactttgggctgggcttagtggctcacacctgtgatcccagcactttgggaggctgaggcagcgggatcgcttgagctctggagtttgagagcagtctgggcagcgtagtgagactttgtacggacgaaaacttttttttttttttttgagatggaatcttgctctgtcacccaggctgaagtacagtggcacaacctcggctcaccgcaacctccacctcatgggttcaagcgattctcctgcctcagcctcctgagtagctgagattattattatttgtttttttgagatggagtctcgctctgtcacacaggctgcagtacagtggtgcaatcttggctcactacaacctccgcctcccgtgttcaagtgattctcctgcctcrgcctcccaagtagctgggattacaggcacctgccaccacacccagctaatttttgtatttttagtagaaaagaggtttcaccgtgttggccaggctggtgtcgaactcccaaccttcggggatctgcccgcctccgcctcccaaagtattgggattacaggcatgagccactgtgcctggctgaaaaatattaaaatatatatattttttaagggattccagctactttgttgttatggagatccagaacccaattaaagcctgtctatcatgtttgaggaaagtgcagtttgagtcaaagcctaktccagtccaatttcatttacttgctggtagtgtcaagctgtttttgtttatttatatatttatttagaggcaggatcttgctctttcgcccaggctggagtgcagtggtgcgatcacagctcactgcagcgtcaacctcttgggctcaaggagtccttctgtctcatcctcagccttctgagtagctaggactacaggtgcatgccagcatgcccagctaatttttaaattattatttgtagagagagggtctcagtgtgttgcccaggctggtctcaaactcctgggctcaagccatcctcccaccttggcctctcagagcgctgggatgatagcaccacatccagcctatcgagattttttttgtgtttttttctttgttttttgtttgtttgtttgtttgtttgagagggagtctcgctctgtcgccaggctggagtgcagttgcgcagtctcggctcactgtaacctccgcctcctggattcaagagattctcatccctcagcctcccgagtagctgggattacaggcgcatgccatcacacccagctaatttttgtattaggtggtttttaaaggccaccgcttcttcagtgttctgcaccaggtctgggaatgttctcagctcacctagtcatgttcagaatggacaaatccctcagaggaagcagacacggtttctcgggacggtgatcctttagagccacaygcacatgcttgctttcttttattattatctttttttgagatggagtctcactccgtcaccgaggctggagtgcagtggcataatcttggctcactacaacctctgcctcccgggttcaagcgattctcctgcctcagcctcccgagtatctgggactacaggtgcccgctgccaagcctggctaattttcatatttttagtagaggcgcggttttgccacattggccaggctgtctcgaactcctgacctcaagtgatccacccgcctcggcctcccaaagtgctggaattacagatgtgagccactgtgcctggccaaatgctttcgtttctttaaaaatcaaagggaaaggaatgactataatccagtctgcattgtatatgtccttataccagtacatttgtgggatataatttttagttctttttatggagaagaagttcccaaggcagatgtgtctggggctcgtgaaaattcatcctgaagtcctccatgtccgggatgtatttcactgctaggaatccctcctgggcagaggtaggatctaaaggtgtgaccgctgaggaagtaggtcggctctytttttgtttgttttttgtttttgttttcagatggagtctgtctctgtcgcctgggctggagtgtagtcgtgtgatctcagctcactgcaacctccacctcctgggttcaagtgattctgctgcctcagcctccacagtagctgggatcacaggcacgcgccaccacacccagctaatttttgtgtttttagtagagatggggtttcaccatgttgtccaggctggtctcaaagtcctgacctcaagcgatccacccacctcagcctcccaaagtgctgggattacaggggtgagccaccgtgcccagccttaatttttgtatttttagtagagatgggtttcaccatgttagctaggctggtctccaactcctggcctcaagtgatccacctgccttggcctccctaagtgctgggatttcaggcatgagccatggcaactggcctgctctgttctaaatgcagatctaaaccycctgcaggtaacctggatgaggacatcattgcagaagagaacatcgtttcccgaagtgagttcccagagagctggctgtggaacgttgaggacttgaaagagccaccgaaaaatgggtaaggccggggtacccccggtacaacccaccccagagtcagaccgtttaatttgcatgcacctgctatctctggtcttctctggaatcacagtgcaaccccacagcccaacctagaaaaatcaggaattgggtgacctacatggaggcacccccagacccttccagcctgtcccttggggtccctctgcaccagttcttcccctctaccaccctgctagatgacatctcctaatrccccaacctcttctccatccagaatctctacgaagctcatgaatatatttttgaaagactccatcaccacgtgggagattctggctgtsagcatgtcrgacaagaaaggtgagagaggatgctggctggtccccgggaggcagggaccccagggtgtctgagtgtcatctcattttatccaaactcaatcaaccctatgtttcytggcactttattctctgccstggttaccacagaggtgttgttaccaggaactgtgggaatccttagttcctgtctaacttggaagaaagaattcagccaagagtcacatagcaagggttaagtagcagagtttattgaaggaagaaacagckctgggctggtccccctggaaaaatagtagtagcaatgcttatttaaagagasagggccagcctcgatggctcayacctataatcccagcactttgggaggcygaggcaggggaatcacttcaggtcaggagttcaagaccagcctggtcaaygtggtgaaaccccgtctctactgaaagtacaaaacaattagccaggcagggggtggcrggygcctataatcccagctactcgggaggctgaggcaggagattcggttgaacccgggaggtggaggttgcggtgagctgagattgtgccactgcactccagcctgggcaacaagagcaaaactccttctctaaataaataaaaagtgaccgtatgctctgaaagaygacacagacatggctgctcaacagaacgagccagcagcagatactgctggtagactctttttatgagactcttacatgatttttcgtgaaggggcgtgagtgggtgtcacttgtaagcatgttttgggaggtctctttgggcgagcaggctctgtggctgtaggtactagcatgcacgtggcatgtctcattagcatcgaaaatctccacccagaggtgtgttttttactatgataatgagcaaaacacaactctagggtgttttcggagcagtgcacatgctcatcatcggggaaaatccctagcaaagttatttccagctaggacctgataagtccccttcagggccagaggaccccaaccacaaggccatgtgtagctaaagtagccatcgtccttttcgctgactgccagtgagcagcgctgtcagtaggcagcctgtctgggacttcttttcccagaaagctcccctgcctgctcatttccgcctatctgcctactctaacagtgtcaaaagctagacagggtgggggtacagtctctaaaattgatgcttttctttctttcttttgtttttgagaaggagtctcactcggtcatccagccataatttatatggtttattataatttataataaatttaattataatatttatttatatatttattaattgtaatatgtttataattataatatataattatatattacataatatatttcatatctacatatcacatattacatatgcaatatattatataccacatattacatatataayataccacatattacatatataatatatcatatattatatattacatatataatatatcatatattatatattacatatataatatatcatatattatatattacatatataatatatcatatattatatattacatatataatatatcatatattacatatattatatattacatatataatatatcatattacatatattatatattacatatataatatatcatattacatatattatatattacatatataacatatatattacatatatcatattacatatatcatatattacatatataatatatcatattacatatatatcatatattacatatataatatatcatattacatatatatcatatattacatattacatgtaatatgttatattacatataatatatattgcatatcacatatataatatgttatatgttgcatattacatatataatatattatatattgtatattacatatataatatatatgtaatatatacatattacacatgtaatatattatgtaaacatataatatgtattataatttataagaaatttaattataatataatttaatgaattataataaaccataattcattataatttaatacattataataaaccataatttattataatttaattttgttgtaatgtataattataatttactactaatatgtcatttgttattgttgacatgttaacatatataatgtatattttattagatatataatataaatgatgtatcatttattattgattacatatctataattataccatatcataacttattacaaaacattctatttaatttaaatatacccaaaatagtatcatttcaacattttgtaaaaagttgcaaaaccacaacccactaataatgtgactataaccttttaatatttgataataatctactagtatatcaaaattactgatgatatattttacttctgtttgcactaagtcttcaaaatccagcatgtgttttacaattcagtgcatctcatttaggatactagattttctttcttttttttttgatacaggagcttgctctgtcacctaggatggagtgcagtggtgtaaacaggatgctaagttttctttttttagtagagacagggtgtcrccatgttggccaggctggtctcaaactcctggcctcaagcaatctgccttcctcagcctcccaragtgctggaattacaggcgtgagccaccgcgcccagcgcaggatgctaggttttcactggaaatactttgatctgtattttaggtttcataaaatttacagttgaaaaggtagattctcaggccgggtgcaaaggctcaagcctgtaatcccattactttsagaggctgaggccggcaaatcatttgaggtcrgagtttgagaccagcctgggcaacatggcaaagccccrtctctacaaaaaaaaaaaaagaaaagaaaagaaaagagaaagaaaaggtagatcctcatactcaagtagttgcaaaaatacttaaacgttttccactcaatcatcatttttaaaaaattaagatttaattcacttactatatgtcacccttttaaaatgtacaactcaggtcgggcacggtggctcacacctgtaatcccagcactttgggaggcccaggcaggcagatcacctgaggtcaggaggtggagaacagcctggccaacatggtgaaaccctgtctctactaaaaatacaaaaaattagcaggacatgsgggtgggtgcctgtaatcccagctactcaggaggctgaggcaggagaattgcttgaacccaggatatagaggttgtagtgagccaagatcacgccactgcactccagcctgggtgacagagcgagaccccatctcaaaaaataaataaataaaaaataataaaatatataattcagtggtgtttcatatatttaaaatgagcatcagttgtttgttttgtttcattgggtttggttttacagacaggatctcactctgttgcccaggctggagcacagtggtgcgatcatagctcactgcagccttgaactcctgggctcaagcaatcctcctgcctcagcctcccaaagtgctgtgattacaggcatgagccaccgcacctagctagatcatcaggtttaaagtttaagtctgaattaaattaaatacatttaaatacaagtacatcaaataaaagtacaaatccagtttctcactcaggcaaaccccatttcaagtgctcagcgctcccccacagcttggggctaccatwtcagacaagcagatatattttggagatttctcttcctccctacacgtagatctctgagtcaaactacaaacagaatgtaaatcattaaatagtggtaactccggccaggcgcagtggctcacgcctgtaatctcagcacttgggaggctgaggcgggtggatcgtgaggtcaagagatcgagaccatcctggccaacatggtgaaaccccatctctactaaatatacaaaaattagctggacatggtggtgcgtgcctgcagtcccagctactcgagaggctgaggcaggagaattgcttgaacccaggaggcggaggttgcgttgagccgagatggcgccactgcactccagcctggcgacagagtcttgctctgtctcaaataattattattaataataataataataataaataatggtaactcccagccaccaccatcatcatctgtcatttgtcgccattgacagcgtttagttcacaggcttcagcaaagacaggctgagttagggagagctcctgcggagtggactaagagctgagacccaggagcctggccttgtccactccccgaccttgacactcmgtgttctgtctctgcccgagcagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgggtcccggggtggcagaggcttcttggaggctgccagggggtaggtagcctgttgcacacacacttgccyggatcctttctctccctggcaggtgagggtggaactactccacaatccagccttctgcagcctggccaccaccaagaggcgtcaccagcagaccgtaaccatcccccccaagtcctcgttgtccgttccatatgtcatcgtgccgctaaagacyggcctgcaggaagtggaagtcaaggctgcygtctaccatcatttcatcagtgacggtgtcaggaagtccctgaaggtcgtggtgagtgcttggggcacccacaaacccttgtccttcagagagggctcctggtcttcgtactattgactcaggttggagatccaggctctgagacactaagaatcatagtgtccagcttaggaaatttggaagtcccagatttcagaagcagagccaggattggggtaaagtgagtgagatgaccccaggcttagaattttaggkggtgccaaaaacctcgtcgaccatcaccaatcaataatttttttatactcgatttraaatttatttatttatttatttatttatttatttatttatttatttttgagacagagtctcactctgttccccaggctggagtgcagtggcgcgatctcagctcactgcaatatccgcctcccgggttcacgccatcctcctgcctcagcctcccgagtagctgggactacaggcgcccaccaccacgcccggctaatttttttgtatttttagtagagacagggtttcactgtgttagccaggatggtctcgatcttctgaccttgtgatccacccacctcggcctcccaaagtgctaggatcacaggcatgagccaccgcgcccggcaatgctagggtgatcctaaggacagtgccctgctgaccatctgtgtgtctgtctgttcttttattcatccaaygactcccmccacctctaacactgcgtagccggaaggaatcagaatgaacaaaactgtggctgttcgcaccctggatccagaacgcctgggccgtggtgagtyggctgcagggggaggggctgaggggctggcagggtaaggsgggtaaatgacctgggtttagtgaggtaggatagggcgggagggagctagagccatcggtrtctctcactcaccctgcagaaggagtgcagaaagaggacatcccacctgcagacctyagtgaccaagtcccggacaccgagtctgagaccagaattctcctgcaaggtgagacacccttgaccccgaccccatgggtcccaggagggcatggayggagccaaattccatctcattctggaggtgtttaacccgcacctttctcttccccttcagctagaacagcccatctgtgatctgttttccctcttttacatttttttttttttttttttttgagacagagtctggctctgtcacccaggctggagtgcagtggcgcgacctcagctcgctgcaagctccgcctcccgggttcacgccattctcctgcctcagcctcccgagtagctgggactacagccacccgccaccacgcccggctaatttttttgtatttttagtagagacagggtttcaccgtgttagccaggatggtctcgatctcctgacctcgtgatccacccgcctcagcctcccaaagtgctgggattacaggcatgagccattatgcccggcctaaaaatttttttaaccatacagatattatttgctatgatcggttttatagaagcctccagatagcatttagttcagcaaagagctttcgctgatacatcagtttattttaatttttctagaccttctgtgcttcttagatgggaaaccagcttaaatgagactcaatagcctgtaatcccagcactttgggaggccgaggcaggcagaccacctgaggtaggagtttgagaccagcctggccaacatggtgaaaccctgtctctactaaaaatacaaaagttagctgggcgtggtggcacatgcctgtaatcccagccactcgggaggctgaagcaggataatcgattgaacgtgggaggcgtaggttgcagtaagccgagatcaggccactgcactccagcctgggcggcagagcaagacttygtctcaaacaaaaacaaacaaacaaacaaacaaaaagacaagcaacatagtacaagagcagaaattctggaggtcatttcttgccccaggagggaagactggagaaagaaagggacttgcaacctgtaagctataaggctttggggcaagagccttggttttttcacctttggtaggggtagaataatagtatctacctccaagggttggtgtgatgattttttttttttttttgaggcggagtctcactctgtcgccaggctagagtgcagtggcgtgatctcggctcactgcaaccccagcctcccgggttcaagtgattcttgtgcctcagcctcccaagtagctgggactacaggcgcccgccaccatgcccactaatttttgtatttttagtagagacggtgtttcaccatattggtcaggctggtcttgaactcctgacctcaggtgatccacccaccccagcctcccaaagtgctgagattacaggcttcagccacggcgcccagcctcgttgactattaagtgagacactctatggtattctcttagaacagtctggaaagtaacattaagcgtgatataagtattcctgaatattgttactggaattattttactgctggtgaaatgagacccaaggaccagggtgcccctgtgaagcacctcccactcctaacagtgcagacccccgaacagccactcagccatgcagcctcccctccccgcagtcacatcctccccagtcctcgcctgtccctaaccccttggccctggctggttgggaggctggaacccttttcacgccaccccaaggtgggtcacccacctggcttgagcaacgtcctcttcccacctgctgcagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaagggtgggctccctgcccctcttggagaccccagggacccctttcygagcgcatccctcccctaagatcccacctcatctcaagaccacgccctcccctgaggctccaccttctctcctagccactcccctcatttgaggccccacctcttctcaaggctacgccctctgaggccctgactcctcccaggccaggctyttcatgagaccccgcctctcctcaaggccatgcccatccyctgagggccccccacctcttctcaaggccacgccctctgaggccctgactcctcccaggccaggctcttcatgagaccccgcctctcctcmaggccatgcccatcccctgagggccccccacctcttctcaaggccacgccctctgaggccctgactcctcccaggccaggctcttcatgagaccccgcctctcctcaaggccatgcccatcccctgagggccycccacctcttctcaaggccacgccctctgaggccctgmctcctcccaggccagaatctcgagaccctgcctcttttcaaggccacgcccatcccctgrgtccccacatcttctcaaggccacacccttctgtgaggcgccacctcctgtcccagccactctyatctgaggccccacgtcctctccaggccatgcctcttccctgagactccaccccctctctgagagccctcccctccctgaaagccccccaccctcaatatccttctcctctctgaatcccttgtcctcttgagaactyttccacctcctcgttctgatcccccaccctctttgagtccttccctytttaaggtcccctcctcccagaacccctccgccaccctgagcccctgtcccctctctgcaccccrcccctgccctttctggcgtgccccctctgctcagccccggctcttttgggggttcctctctcttctctgcagggtacacccagcagctggccttcagacaacccagctctgcctttgcggccttcgtgaaacgggcacccagcacctggtgagtcccaacagccagctcaggccatgcatactycccaccctcaacccccagcagggcccggaccctggccaggggtggtcccttaggccagccttgcccaaayagccctggacctgcagagtccaggcaagcgctggctgagtggccggcggtcattaagcatccttaagcacggaccgyatacaacagctgggtcctggggcctgggaaggcaaaccaggcaaactgggccaggccctggtccctcccccacgctcattggctggttgacatggcagtctctggatctcagagccgattggctcatgctctgtgcccactccaggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattgtaagaggctgggatttagggcaaaatggaagagaggggctcctgagtctcgcaggatgaacacgagagagagccccacctccatgtgcccactgcccaattccctttgcaaagattgggctggggggtgggggcaggsagatawatgagccagaggcgtcactccagcattgcaaaaaccagagacctgcgaagcccagcgcaaaatgaagagacacggcccctcgctcagaaattattaagaatttcattaaaccaagtgcaggggtcctgcctgggaatccctttctcacattcaatccatcaacacctgcattctcccatgatgttataagaatcacctccttctctccatccttatggccagcccctggtccaagcaacactctccccgcccctccttatttggagaccttgtagaaaccacctcctggtcatcatcctggtggcctcccacttttgttggctctcagacactcaccacatagcagttggggtgattttttcaaatccagctggatcagttcttagaaagtcccgtggctccccctgtggcacttaaacacaaaactccttcgagcactggttctcgaagtgtgatcctcagaccagcggcagcaacagcacccatgacttactaaaaatgtgcattctgtggctgggctcgacggcccatgcctgtaatcccagcgctttgggaggccgaggcaggaggatggcttgagcccaggaggtcgaggctgcagtgagccatgatcatgacactgcactccaggctgataacagagtgagaccctgtctcaaaaacaaaacatattctgagaccggaccccagactcactgaatcagaaattctaggggcaggacccaggaatctgaggggtgtgagtgtgtgtgtgtgtgtgtgtgtgtgtgtgtgtgtgtgtgtgtgtgtttgagatggagttttgctcttgtcacccaggctggagtgcaatggcccgatcttggctcactgcaacctccacctcccaggttcaagcaattctcctacctcaacctcctcagtagctgggattacaggtgcccgctccaccatgcccagctgatttttgtatttttagtagagacggggtttcaccatgttggccaggctggtcttgaactcctgacctcaggtgatccgcccaccttggcctcccaaagtgctgggattacaggcatgagccaccgcgcccggcctaggaatctgagtttttaaaagtgcccgcattcctccaggtgatgctaatgtgtgcttgagatggagaatcactgcctcagtctcacctttcaggcttccagacttccagcctttcttttctttccaggctccatccattgataggagccttgctctattgttctacagggcctttgcacatgctgtttctgccacctagtatgctaatccctgccgtctgtgagagttgactccctcagggacactttttctgacctccccaactgggtcacactcccacagttcattmtcrctgcgatgtcctctttcccttgcacagaactcatccacttataagtatatatctcttggctgggcgcagtggctcatgcctgtaatcccagcactgtgggaggccgaggcaggtggatcacctgaggtcaggagttcgggaccagcctgaccaacaggggaaaccccatctctactaaatacaaaaaaattagcttggtgtggtggtgcatgcttgtaatcccagctacttcggaggctgaggcaggagaattgcttgaatccaggaggcggaggttgcagggagtygagattgcgccattgcactccagcctgggcaacaagagcaaaactgtcccaaaaaaaaaaaaaaaaagtgtatatctcttgaggagctggatggaccatgtccatcttccctactagacaaaagctctgtgagggctagagcctgtgtctgsttttacaatggatcaraccgttgtacccattgtacattgcacattgtacattgacatttgcagaaggaacaaattgttgcatgaattaatactaagaagtttgaccttcctagggtagcggggtaacacctagaagagactcagccctgcccagaccccctgattctgaatctgcarggggggatgactgccatgtgtggacacaccggtraccccatccttgctttctgctctcyaycycagggtggattacggaacaacaacgagaaagacatggccctcacggcctttgttctcatctcgctgcaggaggctaaagatatttgcgaggagcaggtcaacgtaagtgccctccatcttcccaccctmccctaccttacccgatgcagagcacagccaccttggagagtragaggttgccttcagggaatttgcagctctcccagtgcaataacagacatcactgcagtcatgttaatagctaacatcttttgagcacttaactcatctaatacagaccygccctctaatagtttcacatgttaagtctcataatccttttagcascctgaaaggtaagtcactcttattatccccagtttgcagatgagaaaactgaggcacaaagagatcaaaggtggggattctttctgtctgccttacaattttcagagggttttcagcccatttccaaaagtgctttctacatcagtgctacatgatcagtacagttgcgtacttgctacttccttaaagaaaacttgggatacagagctaagactatttccttagtccagaggatctttcaggtgattttcaaagggatccgtgactccaaacaggaaacggtgaacactgttggctcatcactgtctctttttcctctggttttgattctgaagcagggaagcttggaaagatgggccgctgagagtctggaatgcctttgtctgctttattgtggttgtttgtttgtttgtttattttttgtgatggagtctcactctgtcgcccaggctgcaatgcagtggcatgatctcagctcactgcaccctttgcctcccaggttcaagggactttactgtttcagcctccagagcatctgggattacaggcacccgccaccatacccggctaatttttgtctttttagtagacatgaggtttcaccatattggccaggctggtctcgaactcctgacctcaggtgatctgcctggcgtggcctcccaaagtgctgggattacaggcatgagccactgcacccagcctaattgttgtatttttagtagagatggggtttcaccatgttggccaggctggtttcgaactcctgacctcaagtgatccacccaccttagcctcccaaagtgctcggattacaggcgtgagtcactgcacctagctgatcgtggggttttgagtgggttgtttaacgtttagctttccaagtgggaagcccaggattccaccctcagctagtggcttctccccccttaggaaaagagatggaggggaggggccagtgaagagaaaaacaaacacagggctgttgcctctaacacccaagagggaccaaagcagagagagagagagagagagagagagagggagggagggagggagggagggagggagggaggtaggtagagagagagagagagagagagaggagaggtggggtcagacaaatctgacttcaaatcctgactcatgggcacttccacccttgagcctcactcaggatgtgcatctgtaaattggggataataaataacgatctctgtatttttaggcctctgagttgtcccagatataacacacatgtgacccagattatacaaaaattgatggggaatttatgtgcaggcaccaaggcatcaaatagagatgaaggtrgcctcagggactctgccrggatgctttgctcctctctcccgtgatcttcattccgttcttggccaataattcagttcaggcagaatatggctgccttccttagagaaaatatcagatcaaggttagggccgccatattcccaggaaaggactctgattggctcagcctgggtcagatgactatatctggaccaatcagctaaggacaggaagtaggtctcagkgggcagacatggctgtttccactgtggccacgtgaatggaagggagaagaagttcttacaaaaggagtggatgtcagagaggcaaatgggcaggaataaaagagatttgtttctgctacaacatagcaacattgtagcagagtatagcacaggctgtgaaaccagactcctggggtcaagagtgtgctgtaatcccaactactcaagatgctgaggcaggagaatcacttgaaccagggaggtggaggttgcagtgagccgagattgcgccactgcactccagcctgggcaacacagcaagactccttttcaaaaaaaaaaaaagtgtgctataactagcttgctggagcccagtgttaaatttccaggaatttttcaagctggtcattaaatacaattattattaaaaactaaatattaggccaggcacagtgagcctgtaatcccggcactttgggargccaaggccggcagatcacctgaggtcaggagttcaaaaccaccctggccaacatggcaaaaccccgtctctactaaaaatacaaaaattagccgggcatggtggaggggggcgcctgtaatcccagctacrcaggaggctaaggcacaagaatcgcttgaacccgggaggcggaggttgcagtgagccgagattgcgscatgcactccagcctgggccagagcgagactccgtctcaaaaaaaaggccaggcacggtggctcacgcctgtaatcccagcactttgggaggccgaggtgggcggatcacgaggtcaggagatcgagaccacggtgaaaccccgtctctactaaaaatacaaaaaattagccgggcgcggtggcggrcgcctgtagtcccagctactgggaaggctgaggcaggagaatcacttgaacccgagaggcggagcttgcagtgagccgagatcgcgccactgcactccagcstgggcgacagagcaagactccgtctcaaaaaaaaaaaaaagcaacaacaaaaaacccaaccaaccaaccaaacaaacaaagttataaaagttacagttaaataaattatattaaacacaaaggttagaaacactcaaactcatygcttcctaaacgccttactcccataatctatactcttggggttacttatgtctgttggatctgtatagtgaaaatactatataatactgtggtactgcaaagctcttcccaactctacattcaacgacaccatattggtaggttgaaatcagtgatggaagtatttacatcayggaaatgagaaaacagtacaaatcatgtcttcccccatccccagaaggctgtgtttggatcctaactctgccrcttayttcctaggtggtctttgcaaaattactgcatctctcagggctcagtatgctcatcaggttttatgagattaaatgtgtgggtatctgaatgacacaaagtaastgtgagctatgatgatgaagaagataaagatgatgatgacgatgatgatgatgactggatgaggtgttcacagtggtatactgaatctggcgcatactagtttatgagtaacaatttggagaatgtctccccaggactttgttcagtgatgtcgcattgacaccgtgaaattggccctggtgggagtatttacaccacagaaattgtaaatcattataaaccaaggatccctcaaccctcccactggagagctggctgttaaacktttacyagcacaccayggggtacgtggatttctccagatacataatagatatgcagcaacaaggcagctcatggtggctaaaatatctgggaaattctcaaaaatggacaaatctaagacaggtgtgtcccaaggacagaaatccctgatgctcaggaagtgctgctcgaatgatccttactaacgtgacagcaatgcccacatgaccggagaatctgatcctctttctcatagagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaaggtgagggttggcctggaggggtgaagggagatgcatggctgaagttcagggcgggagatactgagctgggatgcatggcttttagctgagctgggacrgatgaccctaagccaagctgagatggatagtcctaaggtatcaagctgggatgcataaccctgagctgagctgggatgcayggctctaagttttcgcaggtcctcattgtaaaccacacgagaaagtttgttgcrtcatttattcaacaaatgyrtattaagcattcatttcaaagggagaagtgagagttgatgaaacaagagaggtaaggcaggagccaagtaattgagagcctcraatgtcagccaggacacccaaacaccaggaagtctagcatgcatctctttctgagctttctctgagccatccccaggctggacagagcagtgagcactggggatggggtatcttctttgcagataagaaccgctgggaggaccctggtaagcagctctacaacgtggaggccacatcctatgccctcttggccctactgcagctaaaagactttgactttgtgcctccmgtcgtgcgttggctcaatgaacagagatactacggtggtggctatggctctacccaggcaagtgggcccacagcccctaggcacatgcatccctgtctcctgyggcttcccactggcctcctagagaagacactgaggcccagcgaggcagttcttcattcccacgagccagtgtgattgcagtggagttgagaatcagtttttattasttgcaaacccatctataggttctagaatacaatctggrtactccaagctgtgwgttgagccttcttcttgccccaggtgtctagatcatgttctcagggcccaggttcaggtctaagcctctctctccacctggtgggctctagaccaggttcccagttctatctsacaatcttaccctgtcttgctggtgggttctagaccatgttcccagttctaccaggctcccaatgtcacattgcctcactggcgggctctatastatgttcccagttaccctggggcattacgcaaaccctcttctaggccatggtttcagtaacttcaggcttcagcaacttcaggctccagttggcctcctttctttctggtggtctgtcactcacgttctcagtgttacagtgtcactcttgggttgtagattatatgctcagtatcctctggctacggtttcattctgttcttcatgagtgggttctagacatattctcagtgtctccaagccctggtctaagactctctcctcttgatgggtctagactgcatcctcagggtcgctagacattcagtcttacatttggactttcygatggattctagacatgttctcagcatctccaagtcctggtgtaagtttctgtctctcggagagttctgaacatgtcctcagagtccagtgasctccagttatcacccctgcactctctagtaggttctaggccacattttgatgtcccagctctgatttgaacctstttatcccccactggattctagccactttcccaggctcccagatcaccatctttctctcttgtgggttctaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagaggtacagtcacccagccaagccctcctcactctggctgtctccccctacactagccagggtttactgggaagcaagagggagggccaggtgaccatcacaggcagcagaaggcttaattcccaacatgctctcttctctcttttcactctgcagaccaaggaaaatgagggtttcacagtcacagctgaaggaaaaggccaaggcaccttgtcggtaaggaacagaaacccacacctgcctggcccatgcccctctgccccagagggaccatctcctcttgtccccagcagtcctagtcctgtgggctgacattgtgtctcctctcccatcttaccaggtggtgacaatgtaccatgctaaggccaaagatcaactcacctgtaataaattcgacctcaaggtcaccataaaaccagcaccggaaacaggtaaaaggaatcaaggccttatctgtcaccttcctcctacccctcttctaatgtcttccccgctcctgaatcaacacacaggtataccctctcccatctttctctcttctgtgtttctagaaaagaggcctcaggatgccaagaacactatgatccttgagatctgtaccaggtaagaagctaggtcaccggggttcatcttggccrtccctctatctctagcaagaattcttgcaaataatatccatgatattcagtactttccaagtacacygtgtatctgatactgttctaagtatccaccatgaggtagacaacacagacagtccttgctttgcatgttaatgtgagaccacagcaatgaccacgtaagytgagactgtcaaagcatcttaktaatcaatggaggaaagtacacaatcattccaygacctttaaagttttctttttttctttttagagagatagggtcttgctctgtcagccaggctggagtgcagtggcacaatcatagctcactgtaacctcaaactccctggctcaagcgatcctcctgcctcagccactcaagtagctgggactacaggcgtgtgccatgacacctggctgatttttattttttattctttttagaggcagggcctcactgtgttgcccaggctggtctcgaactcctagccttgagcattcctctgccttgggctgccaaagttttgggatcacargcatgagccactatgcccagcctaaatgtttctattacaacatttaaaattatcatactgccagttataaagatacagggaaatggccgggtgtggcggctcgcgcctgtaatcccagcactttgggaggctgaggcgggcagatcacgaggtcaggagatcgagaccatcctggctaacacggtgaaacaccgtctctactaaaaatacaaaaaaattagccgggcatggtggcgggtgcctgtagtcccagctacttgggaggctgaggcagaagaatggcgtgaacccaggaggcggagcttgcagtgagctgagatcacgccactgcactccagcctgggcgaaagagcaagactctgtctcaaaaaaaaaaaaaaaaaaaaaaatagwataaaacaaaataaagatacagggaaatgaaattcatagtaagatgagtatttgactacaccgtaatttaaaacattagaacattgagatgcaaggtgtatttgttgttttttttttcctttgtatgacacttacggagagtactttagttcaaaaaaatgcttgccttcttctctttgtataatttacaacatggagtaaacatcttttctatgccttagtaccttgtcttgctcctttctaagtttggatcagcttccaatattttatcctttgagctttccatgacacaaaattcctccaagagttcctttaaagtgactttgtattctataatgtcccttcctctgggacatcttcatcctttttgtccccatgaccttccttatttatgctaatacatttgccttccctgagttcctctacactacctatctctcaaatggcagcagggtcaacatcaccatagtctgctattctttgataactccatttatgctstctttgaagttcacttctggcattatcacttttcatttctttgctgcatttttatctttgttggccagttccctcttttcgtgatacattgttgtaaaatctcatgggagttagccacctggagacagggaggcaacagaactacacactttgctgtctgtgcataaattgaagagcagaagctcagtgaccaatcactgatggactttgaaaggagtgacagtaattggccctcaattatgatgcttatcttttatttatgtcgtgatttctagactgaagagttagcaacaaagtttataccatatgcaactactcgtgatcaatataccaaggtactgaaaaagaaccatgtcactgggctactagtgttatttaactgaatcatgcagagtgagggctgcctgtattcttgccttgttttctagaactgaagcatggagggtcaaataatgcatccaatgttatttagagctggaatttgaatccatgcagttgggtgcagagtctgagctcttaatcaccttgaccattacattaccttgctttttatttcctttggggaaatgtttcctaaaaaaygtaacgcccctctgtgctgctatgtgggaatcagaagtctcagtgcctgatcagacctccttgtccaggaacagacccttggggctgacccctccttgggacccaatgcccttctttctgcactatccaggtaccggggagaccaggatgccactatgtctatattggacatatccatgatgactggctttgctccagacacagatgacctgaagcaggtatgaagggctcaggagctgggataagtggaaaggagcctgggttctggaagaggctgcagggagagaggggtccaggagggatttttcacaggctccacctttccccagctggccaatggtgttgacagatacatctccaagtatgagctggacaaagcyttctccgataggaacaccctcatcatctacctggacaaggtaaggctgcatcatcctcccctgggaggcttccaggggcaccctgacctctatctggctggtctttcttttcctttcagcttttgtctctgggtcagactaaccctgggccagaggagacagggtctgtgctgctgagttgtaggggaaggagcttgtaaaataagggggtcaacccagcatcttctataaacatctcatcttctgaccatttgcctcctccaacttgttatcagagtcttaaacaaccattgaaaaaaagcccttttggtttttttggktttttttttaagtgctttgtagagagcaaggtcttgcctcrttccctaacccaatcctgggctttgtttctttctttgatctatttctctcttctgttgttttctttctttcaggagacagggtcttgctctgtcacccagactggagtacagtgtcttgatactagctcactgcaaagtcaaattcctgggctcaagggatcctcctgcctcagccacctgaggagctggaactgcaggyctgcgacactgcacccagctaatttttttttcataaatattatgcttttgtacccagcttttttttttttttttttttttwactgcagccttgacctcccaggcttacatgatcctcccacctctgcttcctgagtagctgtgattacaggtgcatgccaccatgcccagtgaattaaaaaaaaaaaaagtttgtagatatggggtcccactgtactgcctaggctggtcttaaactcctgagctcaagtgattctcccacctcagcctcctaaagtgctgagattacaggcataagcccctggtgcctggccccagctgaatttttgttcttgtttcttcataaatattctgtgtaagtacccagctgattgttttattttttgtagagatgggggtcttgatatgttgctcaagttggtctcaaactactggcctcaagcgatcttcctgcctcagcctcccaaagggctgggattccaagcatgagccaccrcacctgccmcctcttctgttattttctctccatctggcattctctgactctttcatctctaccatgatttgggctttctcctctcccttctcttatttcttcccattctcctatccccatatcctccctgctaactcctgatacccacagggcccctcaatcccattttagtcagcttaagtaacaatagctactaaaacaaaacccctaagaatatggggtcttaacacaacagacttgtatttctcactcatgtaaagtccagttggcatggggggtaaggaagggtccctctgctccatgtagtctctcagggatccaagcaccttccatcctgtggctctgcaatccttaggatcttctgtagttctctgcaggattcattcattctagatggaaataagattgtgcatgggttgtttttatgggcatagatagcaatctgttcagccacctggccacacctaattgaaagaggagctgagaaaggtagtctcactgtgagtctaggaagaaaagtaaatggatttgctgaattgctcattcatctttgccacttcctccttgatccttcagtttctccaccactgcctcagctcccaagacaatgctggactccctcccacatcaccccactgaccaagctcctccttccccctcaggtctcacactctgaggatgactgtctagctttcaaagttcaccaatactttaatgtagagcttatccagcctggagcagtcaaggtctacgcctattacaacctgggtgagcagccaacctagggcctggggtctgatggttccaggggcctgagagtcccaggtatatatgaattgtggggatctgagaatgaaggtctaaggagtccagggatttgagcattcgtagtatgaaggtcccacgggtctgagggtcccaaggatctatgagttgaggttctgaggttctgaggggatctgagaatgatggtctaagcaggccagggatttcaggattagtaatctgaaggtcccagggtctgagagtcccaaggatctatgagttggttctagggatctgagacttgggggtctgatgggttcaggggtctcagggtcttaggaatatgtgagttgcagggggttctgaaaataagggtctaaggattctagatatatgagggttggaggcctgcgtgtcccaggaatctatgaatttggggtctgagggtcccaggcttctgtgagttgagagtctaagagactcaagggtctgagaatcccaaagatcagaaagtagagggggtcttrgggtctgagggatctgaggggttgaagacctagcatctccakgtctgaagactgagaactggggatctgggcctcccaggcrtggtctttggagggaggcccttatcctctcatcttcacatcacatctgccyrcagaggaaagctgtacccggttctaccatccggaaaaggaggatggaaagctgaacaagctctgccgtgatgaactgtgccgctgtgctgagggtgagttccctggagccgggaacaggtgggtctgagcaagccacacttacccaggtcrtctatcccatggtcagggacccccagacccatacccaggggataccaaggggggtaggctcccagggctggccacacccatgggcagtaggccccagataaggagtgggacttagaccctgtctccaccccaccctgcagagaattgcttcatacaaaagtcggatgacaaggtcaccctggaagaacggctggacaaggcctgtgagccaggagtggactatggtgagtgggtgatgggtgggggtcacgcatgtttagctgtgtgtgtccaattgtgtggtgggtggtaggtgtggttgtcatggtgtggcttcaggctgtgggtgtgggtgactgtggtgtgtgtgagagcatgtattgtgaggggccatgattgtgtggggaaccatgactgtgagtggcctaggtatgctcatgtgagaaaaggtagatgtggttgtatgcatcattgcgtgggtggctgtgaggttgtagttgtgtgtggctgtggttgtgtgaggctgtgtggttgtagatggcagtgagtgtgaggtcctgaagttacgtatatgactgtagttttccgtggctatggttgtgtgcatggccatgaggctacagtattttgtgcatatgagtcactctcattgcatagtatgaatagtatgttactagacattgtgggtggctgtgacctctgtgcatgcctatgagcacgactgtgtgtggatggtgacatgggaccctctatggttgtgtgtgtaatgaggggtgggccatagtgtgactggctgtgattctgcaactttctgcttgggagagagagccacatgcccgggtgcacttgcaaaccagggtgcccctcatggtcaacctagcccaccacccaaactgtctgcctctyycccacagtgtacaagacccgactggtcaaggttcagctgtccaatgactttgacgagtacatcatggccattgagcagaccatcaagtcaggtcaggctcagcacgctgcctcccgtggctcttccctggcttcctccccacgactcagcttcttccctctcccctccactccaggctcggatgaggtgcaggttggacagcagcgcacgttcatcagccccatcaagtgcagagaagccctgaagctggaggagaagaaacactacctcatgtggggtctctcctccgatttctggggagagaagcccaagtgagtgctttccctgcgcgtgcgcgcgaccgcccgactgccccgccyatgccacgcccacaccattgtcacgcccctgcgccacgcccacaccacgccccttcctgacctgccattcttccctccagcctcagctacatcatcgggaaggacacttgggtggagcactggccygaggaggacgaatgccaagacgaagrgaaccagaaacaatgccaggacctcggcgccttcaccgagagcatggttgtctttgggtgccccaactgaccacacccccattcccccactccagataaagcttcagttatatctcacgtgtctggagttctttgccaagagggagaggctgaaatccccagcygcctcacctgcagctcagctccatcctacttgaaacctcacctgttcccaccgcattttctcctggcgttcgcctgctagtgtgctgacttctttagccaaggagcatggacctgcctcacctgcacgtggcatgcacctgcgcctcacctccatttcacctgcacactcaccggcagctcacagccccttcacctcttcacttaccggcatcctcacctgttaatcttaccaatttttttttattttattattattactattttaagttccggggtacatgtgcaggatgtgcaggtttgttacataggtcaagtgtgccatrgtggtttcctgcacctatcaacccatcacctaggttttttgtttgtgtgttttgaggcagagtcttgttctgtcgcccaggctggagtgcagtggcacaatctcggctcactgcaacctccacctcccgggttcaagtgattctcctgccttagcctcctgagtaggtgggattacaggcgcccgccaccttgcctgggtaatttttgtatttttggtagagacggggtttcaccatgttggccaggctggtcttgaactcctgatctcaagcgatccgcccgccttggcctcccaaagtgctgggattacaggcgtgagccatcacacccagccccctattacctagttattacgtccaggatgcattaggtcttttccctaatgttctccctgctcccaatgttaccaatattttcatctgaatctttacctgctcactcctctgcaccctcagctgaatccatgtatgggtttttgttgttgttgttttgtttttgtgggtttttctgttttttttttttttttttttttttttgagatggagtttcactcttgtcgcccaggctggagtgcaatggcgcgatctcggctcactgtgacccctcctcctgggttcaagcgattctcctgcctcagcctcccgagtagctgtggttacaggcacacggccaccacacctggctaatttttgtatttttattagagacggggtttcaccatgtcggccagaccggtctcgaactcctgacctcaggtgatctgcccgcctcggcctcccaaagtgctgggattgcaggcgtgagcctccgtgccccgccagggttttttgtttttgttttttagcatcctcacctggccccaacacctacatctctatcttaagcttacctgtatctttaccttaacagcattgttacctatattctcacctttttccacctacatcctctccggtgagtgtattttctctgcatcttcatctgggtcctcacctgcatctttacctgcatgcttttctaggtattttcttgtgttcttgcccacattctcacctacattctcacctgcagatttacctatcttcttactgtaactgcccaatgggttcaccttgcccgctgcctagacagaaccgatttatcagacgggggatgcagtggagaaagagtaattcgtgcagaacaagctgtgcaggagaccagagttttattattattcaaatcagtctcctcgagcatttggggatcagcggttttaaagatagtttggtgggccagacgcagtggctcatgcctgtaatcccaacactttgggaggccgaggcaggtggatcacctgaggtcagcagttcgagaccagcctggccaacatgatgaaaccccgtctctactaaaaatacaaaaattagccaggcgtggtgatgcacacctgtagtcccagctacttgagaggctgaggcaggagaatcgcttgaacccgggaggcggaggttgcagtgagccgagattgcgccactgcactccagcctgggtgacagagcgagacttcatctcaaaataataataataataatagtttggcaggtagaggtttgggaagtgaggagtgttgattggtgaggttgaagttggaatcatagggggtccaggtgaggttttctgtcttccgttcctgggtgggatcacagaactggaggggtcagattactggtctcgatggtgtcagctgatccattgagttcagggtctgcaacatatctggagcactgatcttaggttttacaatagtgatgttgtccccaggagcaatttggggaggttcagactcttggagccagaggctgtatggcccctaaactgtaatttctaatcttgtagctaatttgtcagtcctgcaaaggcagactggtccccaggcaaaaagggggtcttttcgggaaagggctgttaccaattttgtttcagagccaaaccatgaactgaattccttcccaaagttagttcggcctatgcccaggaaagaacaaggacagcttgaagcttagaagcaagacggagacgcttaggtctgatttctttcagcgtcataatttcctcagttatgattttgcaaaagcggtttcattacctgcacctcccccggcatctgtccttgtagattcgccatcaccatcaacctgcagacctgctctgccctctcacctgcatccttacctgtcctcatttgcatcccttctgccctcccgcagcctcacctcactctcccagaccccgtttctagatgggcctgagccaagaatccatgctttggggtgagctgtgtctggtgactgaacccgagaggaggcagtaggggctggcaggcagggcagtgtttccggctggagccccagggaggggaagacatgagtcagcagttagggagggagtgcgggggctttgtggtcacrgcacacaaagtgctttctggtgacagcgctgcttggggagcagcagccttgggtttggagagcaggggcgctgttgctaaaggggactggggccctgagcacctcctctcactgcacctctggtcctttggggactgggaaggtgtctgtatggagggtgggatgcagcctcccagctctgcaccacatcatcacgaaacacccactgaggctgaaagtcacgcctccacagcctcttttcctaagacaccccacaactccaggggtatgggcgaaatagattcacagtctaccctactccatccagctcctaaatgacaaagcctcctgtcaaatgccttgcaactcactggctatcccggctgatatctgccaagaccaccactctacttcacatccttcttctcatttcttttttcttttcttattcattcctcctttcttttctttctcttttttttttttctgtcccccaggctacagtgcagtggcacaatctcggctcactgcaacctccgcctcccagcttcaagcaattctcctgcctcagcctcccaagtagctgagattacaggtgcccaccaccacgcccagttaatttttgtatttttagtagaggtggggtttcaccatgttggccaggttggtctcgaactcctgacctcaggtgatccacctacctcggcctcccaaagtgctgggattacgggcatgagccactgcacctggccttcactccccctttctcctgtttgggattcatttgattcatttcttcaacatatgggggtgtttggtgcttttgtttgtgtttgcttttattttgagctaaaacctatcacttgaggctgtgaacggtgcagataggatcttatgaaacttacattctaaaagggggagcaggataggactcatgaaaacagcatggggccaggcgtggtggctcacgcctgtaagcccagcactttgggaggccgaggtgggcagatcatttgaggtcaggagtttgagaccagcctggccaacatggagaaacctcatctctactaaaaatacaaaaaagtagccaggcgtggtggcgggcacctctaatcccagctattcgggaggctgaggcaggagaatcgcatgaacccgggaggcggagggttgcagtgagctgagatcgggccactgcactacagcctggacaacaaagcgagactccatcccccacaccggctcccccaaaaagaagacagtgtggaatggattttggatggtgaggatgtccaaaaagaaaagttcacccatgcagtgggtccagcggttaagaagatcacttagattgagtggcatgagggctaacttatgtgataacaaagctaggctatatgaagtcatttggtaaaacactagtctaaatgttgctagaaaggtattttagccgggcacagtggctcacgcctgtaatcccagcactttgggaggctgaggtgggtggattacttgaggtcaggagttcgagaccagcctgaccaacatggagaaaccccatctctactaaaaatacaaaattagccaggcctggtggcgcatgcctgtaatcccagctactcgggagggtgaggcaggagaatcgcttgaacctgggaggctgaggttgcaatgagccaagatcgcaccattgcattctagcttggccaacaacagcaaaactctgtctcaaaaaagaaagaaagaaagaaagaaaagtattttatatttctttacttttttgtcttttttctttttttcctctttgttgagaacggggtctcactatattgcccaggcaggtctcaaactcatgggctcaagcaatcctcccgcctctgcccccctaagtgctgggattacaggtgtgagccactgcacctggctagaaaggtaattttcagatcatgtcaacaaccacagttgactttcaggacaggagatgagcctaggtaatgtgagtgggccgcacctgatcagttgaaggtctgaggagtaaacaccgaagtttcctgaagaaggaattctgcctcaaggttgcaacttagtaattctgcctgagtttccaggctttaggctttaagacggtagtgtcacctcttacctgagcctccagcctaactggcttgtcctgtggacttcagacttgccaactcccatgattgtgtgagctaatttcttaaaataaatgtgttacacactctctctgactctatacatctctctctctctctctctccgtctgtctttgtatctctgtgtccctgtctctctagttttccatgtctgtctcttctctgactctgtatctttgtctgtctctacagatctcttttttttttttttttttgagacagtctcatgccattgcccagcctggagtgcagtggcacaatctcagttcattgcaacttctgcctcccgggttcaagtgattcttgagcctcagcctcccaagtagctgggattacagaagtgtgccaccacacctagctaattttttattttttatttttgtatttttgatagagacagggtttccccatattggccaggctggcctcgaactcgcgacctcaggtgatccacatgcctcagcctcccaaagtgctgggattacaggcgtgagccaccgcacccagcctatagatcccatctctatctctctgtgtatcttctattggttctgtctctcgggagacacctgaccaattcagggagggctcctgtgagaagtttcttgagtcaagacgcagatgagcagggggagcctgctttggagatctagggaagatggttcccagcagcaggaagaggaagtgcaaagacccaggatatctgtctggggcagagtgagcaaaagcacgagggtccaaccacagaggccccagtgaagggcacttcgtgtcttagcctaagctcaggggcaagctggcagcaaactgtatctataaagggccacataagtgtttttggctttcagggccaagaggtaaaatcaaggatattacaaagatacttatgaaacaagacagaagccaagtgcagtggctcacgcctgtaattctagcattttgggaggctgaggtgggcagatcacctgaggtcaggagttcragaccagcctggccaacatatagacaacatatatgttacaacatatataatggccaacatataatacaaaaattagctatgcatggtggtgggcgcctgtaatcccagctactcaggaggctgaggcaggaaaattgcttgaatccgggaggcagaggttgcagtgagccaaaatggcaccactgcactccagcctgggtgacaaagtgagactctgcctcaaaaaaaaaaagaaagaaaaaggctgggtgcggtggc

SEQ ID NO: 17699 - DNA, 50353 bp, Homo sapiens
gagcagagttagtggtttactgtttttccactaagtaagtgtataggataaatattatgtgcctactgtgtgccaggcactcttctaagtgtttattgttcatttattttctcgaatcttcacaagaatgctctaagtcagcaaatggaagtactaagmaatcaggtagtgtgtctaaagtctcacagctaagtgaatggcagacccaggactgaaactgatcattcagatgcttcttttctgtgtcctagtatttctaaaaagatatttgtagaaaacacggcacttgtctctaagagatattaacactggtccttcctgctccattgaaattatggatatttccatagactccctggtcacccacaatgattttggggatggtagatatttttctataccttgcatataaattaaacttaacaaggagccattgccaacgctaatatctcaagaatctgtggtggattttaaacgcgtcagctctgcctgtgaaattctgcgcacacaatcaaggacagatggggttgagagctgaattgcaagtgaaagctggaatgtccttattcccattctgaagcaccagggctctgggaggtgcatgtctccttcaaagcttccaataccttgccagtcttatgtgatgctcagagaggcgagaatgactcctcctcatcattaccaacaacaaccatcaatagttattgatcacctctcctgggccagatgcttggtgatgggtggaataccaagacgggtaggataaaacccctgcccttaaagtttaggctctagagacagataaccataatccagggcaatatctcccacgtgtcatagaacttgatatctctgcttctggatctggccagtctacttcttaagcatctcctgcatagctccaagatgaaacaaagggaaggaggcagaagttctggccagtcgatgtaactgtggctgcattttccatgcaaagcaggtttgagtcaaactaggcagttaatccatcctgacaatcggggaaagtggccaggctgacactggatagttaaagagggtttttgaaatggtatgtaatcatctctcagtatctgtggggcattggttccaggacctcctgcagaaaccaaaatccatgaatgctcaagtctctgatataaaatggtgtggtatttgcacataacctatgtgcatcctcttgtatactttaagtcatctctggattactcttaatacctgatacaaggtaaatgctatagaagtagttatcgtactttatttgttttttacttgtgttattttttatggttgcattggtttttttttgtttgtttgttggttggttgattggatttttgttgttgttgttgttttgagacatgggtctcactctgtcacccaggagtgcagtggcgcgatcatggctcactgtagcctcgacctcctgggctcaagcagtcctcctgctttggcctcccaaagcactgggattatagatgtcagccaccacacccagcctgtattgttattttttattgttttattttccaaatatttttgatgttgtgaagggatgccagttttggtggttggttgggggtagggcctgaattttcctaactgaattttcctatcacttatttgttgctgagtttgctaccgctgtccctacaatagaactgttcaatggggttccagctgatgttgattttacttttttagagcctcctattcccttggatctgaaaccagcacttcccttgcatgtttacagacacgcagttccctatctttatggacacatatccactcctacagggtccacagtgccctgtagatcatggccgtaaagtatcagccctgattcctctttggctttgttttcagaagcctgtgacttctgaaccaaagtcagcctccaatctgaggctgggataatgacatatgctgaatggaagaagttggaactgattgttaaaatgtttgaacagcacaggaaacaggaagcaatgagaaacaaaagcaccctccagctctgagtcacagggccgtctcctctgccaggccatgtcagccacagcccagggtacatgtaattgggtaatagatattatttggcccggagaaaaagctgtccgtctgaggatgttgtatgccaaccactttaactagaaagataacagagccactatcaaagagcctcaaacttcaatttcagtctcagagagttctcaacaggatgctctggctagaaattattagttctttgcaagggctcggagtccactagtatagactgagctgttactttttactggcaatgcttcatttttaagttttgttcactattatttaaataataaatcaagaatcttccacaactttgccattgggcctaaccacttacataatcacaatgtacataaagtgttgtttttatgtttttaattgtggcaaaatatacatgacataaaatttaccattttaaccatttttaagtgtatggttcagtcgtgttaactatacccaccttattgtgcaactgaccaatctccagaagttttcatcttgcaaaactgaaactctacacctattaaacaatcacttcccatttccctcttccctcagaccctggaaaccaccatcatattttctatttctatgaaattgactgttatacttacatcatataaatggaattacatagtatttgtcctgtggtgactggcttatttcacttagcataatgtcctcaagattcatccgtgttatagcatgggtcataatttcctttattcatccattgagggacatgtaggttgctttcaccttttagctattgtgcataatgctaccgtgaatttacataaaggtttttttgttggtttttttttgagacagagtctcactctatcgcataggctggagtgcagtggagcgatcttggcttactgcaacgtctgcctccgtgttcaagtgattcttgtgcctcagcccctcaagtagttgggactacaggtgtgcagcaccacgcctggctaacttttgtatttttagtagagacaagattttgtcatgttggccaggcgggtcttgaactcctgacctcaagtaatccacctgcctcagcctcccaaagtggtgggattacaggcatgagccaccacgcccagccccaatttacaaaaagttttatattctacctttttactttctgtcataatatctgtgtgtatatacatataatataaattaaatatattatgtataacatattatagaatataaattacatgttgtatatgtaatctataaatataaattacatgttatatacgtaatctataaatataaattacaggttatatatgtaatctataaatataaattatatatttatttttatatatacagttttttccagtttgatatatagtcttcatcataacctttttttacatctgttttaagggccacatgacagtccttcaagctcatgcacttaaataatttctacagttggacatttgagatgtttgtagtttttctctaaatcctatgacaaaaattttgtacctatgatttccctcccttcccccatattttagcatacctttttagatagattccaaggaagtgaaattactgggtcaaaagcaacatacattttataacttaaaagataaaagatagaaagccgcattgctttctaaaagaatggtatttccctagctactaacagtgtatgtgaatttccattccacagtactcacagtttttttttttattctatgattaaagggaggaagttgastgctcattcatttttaatggacaacaatttgattattaatagtgatgggcatttgtgaggagaccccagacttggccagcctgtgaatactagcatggttacagtaaactgaaaaaatatatctatttgatctaatatgtattatccctataatatatgagtatgtattagaaacatgcccaaatagtacgtaatccataaatgatagctactgttattgttgctgttattcttattattgcccaacatgtgatgattcttagtctatacctgctttcccaggccctcaatttcccaaaatcatgatttcccaatttttggggggcatccccagttaggtgctgtctcggaacattcctgtgaggctgctctacccaagccctctccctctagcgccctctattggacacaggtacactatgccggaggctgtcaaccctcagagttctaacactgtacttagggtggagggcatggtggcagaattgtcacctggactccaaaaaggatactgccttatgcccagagtcttgcaaatatctttattaatacagttcctccatcttttggccctaaccccctcattccctagaggctcaggccacaggccctgcatgtaagtggggggcagtgtgccatgctccctgtagggagtggacagtggcaccccagagatgtccacctcctaatcctggaacctgtgagtatgttgccttggtagtcccgtatggtaaaagggactttgcagatatgattaaggatcttgagatggggaggtgatcttggaatatctgggtgggcccagggtcatcccgtgagtccttacaagtgaaagagggaggcagaaggctcagagtcagagggagagttgaatatgcattgctgctagctttgagggtaaaagtggctaggagccaagaaatgcaggagatctctggaagctggaaaaggcaaggaaacaaccatcccccagaatctccagaaggaatgcagccctgccgacaccttcattttaacccggtgttccagaactgcaagatactaaatacgtgttgttttaagccaccagattgtagtaatttgttacagcagcaaactatagcgatgaatacattctgctgatgtctttgtttcctatccctatttctcgctctaggtttacattttaaaactgtttccatctaggccgcgcgctgtggctcgcgtctgtaattccagcactttgagaggccaaggcaggaggatcacttgaggtcaggacttcgagaccagcctggccaacatggtgaaaccctgtctctactgaaaatacaaaaattagctgagcatggtggcatgcacctgtaatcccagctactcaggaggttgagattagaggattgcttgaacccaggtggtggaggttgcagtgagccaagatcatgccactgcactctagcctgggtgacatagcgagactctgtctcaaaaataaaaaaaataaaattaaaaaactattttctttttttttagcgttaaatcgaaagttccctagttaattcccacaattaggaggggcccaccagttccacaaataggaaatctctgcactgctcttgctcataaagtgtatttgctttttcataaattgcttatgttctttgagccaccaatggtttaatgtcagaataatatagatcattagagcctctcaagatcccacaaggaactgcactttctcctgtagttaaccatccagtcatccatgcaagaaatatttattggatgctaccatgtatcaggcactgagccagtattgagatgtgaagacacastgcataatctaagcctttacagaggccacagatgttgggtttttatggcttgagaacaacatacattgtttctttccaggaagctaattggggtacatggagccactttgactaagtagcaaggaacaggaactgcacactggttccatcttggcttccaatttgtattcagacccaggcaagagttaaagagttcgatgatagataagcacagatgcaaaacagtacagtccagtgcctctttgcttaggctaatatstgccctctctttatcctctccagccctgccttcctgcctttgacgcagggagctaagggtctgaatgaaccctgttggaggttgcaattaaatctttgtggacaaaggcacacacacrcacacatacacagaatcctcagataacaggaggcaataaatccaacagcacatccacgttcagagaacagtgtccctgctgtcttgctaacagctgccaatacctcactgagtgcctcacaccaacatgggctccaaggtaagatttttctctctccggacaaatttaatctttccttgtgatttgtgtctctrtcagaggattttgactgttaagtaaagtttactattgatttgttggcaaattcctggttttgtttgtttttgttttgggatttgggtgtgygtgtttctctctctttgtagtacttacttcactcactatgttttttaattttccatggcttgtcttttattcttatccatayatatcctaagtcaatttgtattcagaaatacmtcctttayayagagaaatgaaggatcttaagtaattgcatgcatttactggttaaaacttaactgagaatttggttcacttaggaccttggtcacgttaatatgtagtagtgagagggttcttccagccctgggcttagaacagagtacctcagtgtttggggtactcccaacacctgaggctgactattgaatttcagtgataatcatttaaaattatttacttctttaattacaaaagtagctcattattgaatatttagaaatacacagaagataactgaagtcattgattataaataactggcatttgagtatctctctactctctcaaaaatgtgcccatatatttatatttagacaattgagataaasttgaaaacacagtttaatttcccttttttacttaacattatagtaatagtattttctgtatcattaaaattatttgaaaatataatttttaagagccgcttaataatccaccattaacatgtttgacttttttcactaagaaaaataattctgcaattgatcattttgagtataagtctttggctgcatctctgaccttttttcttttgtaggatgggttccttgtagtagagttactaagtcaaagagtatacaatttttagggcccgatagatttcatgatggtaatctattttaaaatttaaatgagtgatattgttgataccacaacagaagccacgtcaaagaaaatgaaattctccccagaaactcttattacttgaagtttgacaaggtactgtgacttaatgctgactaatgatatgaaatcctraatagasaactaatcatgaaagtcaatattttattttcacagatgaaggcatctttctgatcaggggtttgtagctcaaacaaaagaatgagcgtgcttctagaaccacagagcaagggaacatggtagaggataagctggcaagttgaaaagcgtgggatttcatccmagtttgacactaactgtgcaaccccaaacaaatctcctaaccttcagaggctcggatttcttgtctatgagatgaaggttggtctacatcagtgtttctcagtgggcagcccaagtgacactgtgccacatgaaatattttggggtagcacctagaacaaaggtcatactttttttgcatgccacataaaataactttttgaaacatgatatcaatatctatgttggttttaaaaattttttgagagttaggggtcttgctatgtagtccaggctggactcaaactcctgggctcaagatatcctcccacytcagcctcccaagtaactgagactccaggcacatcccaccatacctggyagtatctcaatattttaaaagagtggatctagaggaaaaagatgaagtaaatgatagtacaggtagtccttagatatgacataaaccatcaaggtgataggcaaataaatgtcggatgtttgaaaaacacagggttaagtgatctgtagagcatctatttttatctggatttatacctagccattaaattcaagggaaattaatggctagatataaatccagacataaatagctagtaagcgatgcttaccaggaaggcattctgggaaccaggtagagttattgagatttataagaagtgaacagtgatacagacatggagatgtttccaaatatcatcctactacttgcaaccctttgcacttttcgttttaatagtgagtttccttcgtctgggcagactccctcccctcttccataaaggctgcaggagacctgtagctgtcacaggaccttccstaagagcccgcaggggaagactgccccagtccggccatcaccatgctccggmccattctggatgctccccagcggttgctgaaggaggggagagcgtcccggcagctggtgctggtggtggtattcgtcgctttgctcctggacaacatgctgtttactgtggtgggtacgtttgtgggtctttgtgctgagggttaatttgctgtgggccccagcaggcagtgtacaccctgcttgagttcaacagtgaatccatctgagaattttcctttttatgctcaaaaacacacagaggttgttggggactggaaaaaagccctgcagaaaatggagtctgacacttgtcaaacacagctaaaagactcaggaggttcaaagrgcaggaggtccagagagggtctgactggagaagaggatggcccggagccagaactggctgtgcttttctttctccccacactgtcttctcaaggtgctaatgactccaagtgcctctgaggcagcgagatcttctcacaggggtgcctttctggactctgctctataaaaacagcatattttatttggatatctgatttaktatcaagaccttgccttccttgtggttctttccctcagaatcctgctttttttagttgatactctcctaatcattacattaagttacacccttgtataaatgggcactaaaaggtttctcctcttgggtaaaacatatgtttttaaaaaaggatctttctgagacaagttgttaatccaatacaatcacttctcattattcatagttctgtagttatagttatgctctataaagtcgctgcaaacactgaattagtgaatactgaatcattgctcccagggaaacmacmcacacacacacacacacacacacacacacacacaattataatcttaaatcttaaacatcgtggtacatcgtgttttctttataaaagagaaaaagaagttcagaagtgttaagtgacttgcccaaggcctctccactagcaggtgccagagttgggattcaaaccctgtccaggggtcccagagctgaggctcctctgaccaccctgcccttcctcctcccatcccctcctgtggccaggtctgtgtgagagctggacatgtctgtgaaatgtcgtggtagctcagtgtgtgttggtttggggggttacatgtcaatctaagtgagtaggagagttagccaatgtggaaaccatgaacaatgaggactaactgtataaggtcagaatttagctactttagctaataggataacttgggcaggcacagtcttttagtaggttttaaccatgccactccagataccagccttgggcataaggctgaacctcatcatagtcccctgatcctagtagtggtaagatgacatctgtccttagcccccatcacctgtcctccttgactttcagtagaattgacatctgtccttagccccttgagtttcagtggtaagatgacatcggtccttagcccccatcrcctgtcctctttgactttcagtgccaattgtgcccaccttcctatatgacatggagttcaaagaagtcaactcttctctgcacctcggccatgccggaagttccccacatgccctcgcctctcctgccttttccaccatctkctccttcttcaacaacaacaccgtggctgttgaagaaagcgtacctastggaatagcatggatgaatgacactgccagcaccatcccacctccagccactgaagccatctcagctcataaaaacaactgcttgcaaggcacaggtttcttggaggaagagaytacccgggtcrgggttctgtttgcttcaaaggctgtgatgcaacttctggtcaacccattcgtgggccctctcaccaacaggtatctcactgggtgcagtgccccgcagggtacacaggagtaggaggactagaaaagtatagaaagggggttggaagggaaaaagaagaaatactcacttgtatgattccycaggggagtcagctattcggaaagctcgttactcaaagaataacatgttactgatgaaatgttatgggatcagattttcttagtgatatattgagtattgagtaccaagaagagaaccatgaacagcagtgtgctgtgatgttctatcagtgacctggagcatggcttgaatgggaaaagggtatgaatgggacagtcctgttgtaatctagagcactggcttcccaggagttgtattgacgattattctgatattttcaagagatatacactccacctaggctatcmtttctggaaatgagaattttggccctgatctrtggtcatatctgcatgtttgtttgtttgctcatactcatccacatgccctatttcrtctccacactacattcagaggcatgttttaccatacacccaaatagctgyatttctgctcccacttacatttaaaaatgtagtccatgtatgtgagtgcctkttggaattgtatctttttttttttcaattcccttttaggattggatatcatayccccatgtttgctggctttgttatcatgtttctctccacagttagtaagtaatttgcttcctcttttcttcccttcactgattacctttgattttatcaagtgaatgcggtgtagatagcagggtaacctagaatgtaattaggcatctgactaagcagactggaatattggtttaaatgytctgctgtttttggtatgtggactagaacagtagtgacaattcagtctagttggaattggtctattctgctatagaagaacagatattttattcacttcacttcagctggacataatgagagctgtttgaatatgtatgctaygkggtgtgtgtgtgtgtgtgtgtgtgtgtgtgttatatgcatcagtaatcccttgagcaagtttaatacaaactttccatctatgagaagcaatgatattattttgttatgccatggaaaagggcaactcacaaaaaaatggaaattggacaataacatctggaaaattccaaaaagcctactgcttttcagttaagggctttaaaggttaagcttagaaaagtaaatttgctaaagaaacaagaaagagaaagacaaatactctayccaggatcagctaaatgtttctaataaaatggagatgggataaacacagtacatgagaaaagtaagtctggaaattgatgctgagaagtaaaggaagaaggaatgaaaagggttagcgttagcaggttaaggcaggggaaggcagcctgtggatccagccttggttcccgatggccctgctgatcctctgctctccaacaacacacctccttctccctcgcgtttttcttytcttttcttttctttttaattatactttaagttctagggtacacgtgcacaacgtgcaggtttgttaygtatgtatacatgtgccatgttggagtactgcacccattaactcatcatttacatyaggtatatctcctaatgctatccctcccctctcccccgactccatgacaggccccggtgtgtgaagttccccttccggtgtccatgtgttctctgttcaattcccacctatgagtgagaacatgcctctcatttttcttattacctttctgttccttgtctactttctgtcttcctcttcctcaacttttcttctttcccagcacagaacttgattcctagcaacccaatatttaacaagaatttgttgcattctgggctggaaggctgcaaactgcaagaacttgagatgtgaggttgtctctgagaactacgtcttgtttgtgaaattttagtggacttgaagaaaatgaagaaattcaaattagcactgttcatggaacttctagcagttcagcctaagttagacagcaaatttaaaaataataagatgccaggtgccctatttcatcaaatgaggcttaagatttattccaaacaactttatgcagtgcatgtataatgcccagatggccatagtcacataaagaatgaaaagacatgattccagctatcagaagtgtatatgatggttgcctggggagacatgagacacacactgagaagtaagacaatgcggtgtgctagtggatctgagacgttttagcatgatatccttgcctgattctctgccaagaattcatgtgttaaaagctttacttttaaagtaaactgtatatgttaagtaattattgtttaacttataccaaactatatatgttaaataattattatttccataggatagctgtgttgctatatggagttggcctaattctaaccaaaagaaaatacatttgatgtttagggtatccttgtccaatgttctaaaaaatacttaaaagagattgttgatgcccgttactacccttaaaccctccaccccccaactaggagccatgcctaatgtaatcaagagtgaaatggtggcccatgtaaagggtycaaagtgaaaaaaataattgctttggtattcctaaatagaatgaccaactctcctggtttgcctagaattgaggggtgtcytagtccatttagcattgctataaaggartacctgaggctgggtcatttatattagaaagaggtttgttggctcatggttctgcaggctctacaagaagcatgacaccagcatctgcttctggtgcgggcctcagggagcttccactcatggtrgaaggtgaaggggagctggctgtgcagagatgagagaggaagaaagagagaggagagggaggtgccagcctttttttaaccagcagctcttgagagaactgtagagtgagaactcactcaccaccaaaggaagacattaaagtattcatgagggatccttccccataacccaaacaccttccactgggccccatctccaacaccggggatcaaatttcaacatgagatttggtggggacaaacaacccawgtccacactgtagtgaggggcttcccaggatgtaagacttcctgtttttgtggggtattttgagtttcagttttaaaaacaaggaagttctgggcagaccaagatgagtgggtcactctattctcaaaggacattgggagagtagacagaaaagactggaaataacaaagtctgagaaaagatgctggtggccaggaaagaagagaccaagaatgtgcatctttgggagacaaggagaagttcggtgtgatcatgtctgccgggaagtaatgggagaagattaaaaacacaaccaaagacatctgtaatgaatgggcaaagggattacaattcttctgattcagacacttcgaggagattattcttaccctaggagacattwttctggaattggaggtgagacatgtctggacttaactaccctgaccaccagcaccctctgatttagttttgtgttgcgggaagtcagggaccctgaatggaaggacctgctgaagccatgacagaagaacataaatcatgaagatttcatggacatttattagttccccaaattaatacttttataatttctcacacttgtctttactgcaatctctgaacataaaattgtgaagatttcatggacatttatcacttccccaattatcaatactcttataatttcctatgcctgtctttactttaatctcttaatcccatggtcttcgtaaactgaggatgtatgtcgactcaggaccctgtgaggattgcgttaactgcacaaattgttcataaagcgtgtgtgtttgaacaatatgagatctcagaaccttgaaaaaagaataggataatggagatgttcagggagcaaggggagataaccattaggtctgactgtctgggagcctggcaggacagagccatatttctcttattgttttggatgacatattcctgttggatctcagtttcctgggtgtccatcttcaacasactgcctctcttcamggacaataactagatgttatttttattttgcatttgctacagagtctagcagagctgcgcattcagtataatttaatacctgctgattttgtctggttaaaagatcgttcaatataagatataaaaaaggatctgattgtatcacaagatattrttttctacccaattcctataatcctcgaagcacctacttactgtcactgtactccagatgatcctgtgggacccagcaatggtaaagaccagatctggattttgcacatggacgatccaggagtatgatctaagaaccagtttccagcctaggacactgagcttcatggacatccctcatttcagtggacagaatgttgggttcttggcaagagatgtacagactcagccttccatctgctgtgtggtgactcggtttatacttctgtggtttctcagttttcttgccatttaaatagcaaaactgaggagtgggagattgaaaagacarctcaaaaaacagggaacagtcatcatgctttattaaaaacatatgcatcaagactcatatctgcagtatcacgggcatgttctctggcggctggggaagcaaaggcaatttgctaactgcagttatcttgctattctctctgcccagtgtttgctttttctgggacctatactctactctttgtggcccgaacccttcaaggcattggatcttcattttcatctgttgcaggtaacactggcaactcatcatgcacacacacatgcaggcatgcacacacacacatctcttactacctcagatcctatatttacatggagaaattaaggaaaatgtcacctggataggtagaaattgtgattcagaaataagggaattgggctgggcacagtggctcacacctgtaacccctgcactttgggaagccaaggcaggaggatagcttgattctaggagtctgagaccaacccgggcagcctgggcaacatagtgagagccctatttctattaaaaaaaagagagaataagttagccaggcatggtggtgtgcacctgtggtcccagctacttgggaggctaaagtgggaggatggcttgagcttgggtggtcaaggctgcagtgagccatgattgtgcctctgcacttcagcctgggtgacagagctagaccctaactcaaaaaaaaaaaaaaaaaaagaaaggaattacagagtttctaacagggtccatagatctctgagcctgacataacttcctctgctaatattcagatgcagctagctcaggtcagagcaagcctccagtgaagctatgaagaagggcaggctttcatttagtgccactctatggtcctttttctgtccccctcttagtactttataggaataatcatgttagtactactggtaacaccagcacagttttcaaagtactggtgaatataatatctaatgcaatcttatgaagttggcattttatgccattttacccatagctatgaaggccagagggtccagctgccgtacagcactagcccacactttcttccaggtctgcagtgctttcctgctcttccctgggcacccctgttaaatagaatggtctctgtgtgcctagattttcctttccctgatctgctctgtaacccctcattttgggaaatgtgctaggaaatgataaaatgttatgaaacatggtataatcagacaatggattttctgtgttatccttccagagggcttgcactatcaacaatattctgaacaggagtggacaatgtgggggcttgggggactagggagggtagtacttgaaaaatactacgggttaagttttgtaaaacccctcaaactgaaactctagctaagattgtcactgaagagataacagggtgggaccaagggctctgagaggcggatagaagccccccagggggccagctgcatctgtaactctctgcgcaggtcttggaatgctggccagtgtctacactgatgaccatgagagaggacgagccatgggaactgctctggggggcctggccttggggttgctgggtaagtggcaccagctggagctctgggttcgggagggtgggactytaggaagcaggtgttcccgaggtgtagaagacgagtattttccttcccttgttggcctcatcctatttcaactcctttagaaatatcactgagaaaaggttaaatttccttctccttaagaagctgggaaacacataaacgtcggagaaaggtccggaagcccagcctgttggaggaagtgagcctccccgatttagaggccactgcttcgcctcggttcccatgcacacagcaccagagcatggctgctgccagatgctctgctaaatctgttacacgcataatctcttttattcctcaccaccaggaatgaaaggaggaatgattttccccattatagagatgaaaataagaatggcgaaaacaccatccaacatcacacagctaggaaacgccacagccaggatacagactccgattttctgggcttggaaacccaagccccaaacgataaaactaccctttctttgaggctcctccctcatacaacttaattgacaagctacatgctttcacttattacatgccaagcacagtgccagtactgtagggtgggaagccccaggcatagttcctgccctctaggagcttacaagctcatcgaaaacaaaacacctgaaatttcttccccggcctatgccccaccctctagccccatgggaagcagaggaaacagaatccctgttatttgctagtatccatcaacccaaatgcccaagctaaaccctgtgcatcttgaaatcctttatcatgtcccaaatgaataagctcccaaatgaacaagcttgttagatcctcaacagccactcctggctccttgtcacttctgggttagaatctggcagcatcctccctcttgtgtactccctccttccaccacgatgctgcctgaacaatcytcctgagcccagagcaggtgatgtttctcacctgatgtttctccataggccgcaaggccaagtacatgactcatctgcatatacaaggttcctgcatatgcaaggctctacttttctcctcgcaaatattcatactctgctaacacccgctttcttctttttcttctccaactacacactcttttctgacacctctgtgttcttcacacaagcttcttcccctccagatactctacacttggcaaagccctcgtggctgcctgaaattcctgagacattgactgtgctttcattgcatgcaacattttactgtcaaactttcaccatgctttaattatttgtgtccctccctacacacacacacacatacatacacacacgcgcgcacacrcrcacacacacamacacacacacttcctccactagaaagtgggcttgatggggacagggatcatgtctccatctctgaattcccagagcctcaggtggagcttagcccctagsaggccttctgcaaatgctcacggggtaaatrtggataattctcactgcaaaggactcaccctcacctctggaatctgtgtctcctatgcctctccagtgggagctccctttggaagtrtaatgtaygagtttgttgggaagtctgcacccttcctcatcctggccttcctggcactactggatggaggtaagtcaccatcagagcctmcagcaggtgacagcccmggtcaggttgggaatgcattatgttgtagtgtcagtcttcactaagartgggcggtttggacatgttttgatggatcaaggactgccccgttgtagaaaagaaagaagaaactcagggagttaaattkatgcataatagggtggtagcactacagctgttattggagcccccagctaatcagtagacacgctgaactgtctcaccttctttgtttcttagcactccagctttgcatcctacagccttccaaagtctctcctgaggtaagcagacacaaagctccatttctaacagttatacaggatggctgaatgcaggaacccaggcatgcctgccaaaccataagaagaaaagtgaagaggaatagggtcagcgaaagtgagaactgtgtttggattccagkatagggttaygtttcaggtagtgtgggggatagtgacgtatttggcttgatgttggacaaagatggtggaagaaccttgtgcataatcaaagaagccatagagaatctatctatctatctatctatctatatattcgacacatatatggggtgtgtatatatatattcatgtatatctggagatctccatatatatatatatatgtgcacacacacatgtaattatagctaggagataatgacattggggactgagtatttggagctrtaacatcatctcagagatgaaggctgtgggggccacctagacaacatcttctgcaataaaagacatcctctgtgaatatccctaactgtcattctgtcacagttaataaatatcagagttggtacttgtttgactctaagccaaaaacggctctrgaaaatccatatcccaccacgaaggaaaaaaagtaagaaagtgcatcaagtgtaaaaatgtttgatctaaaggccttgactttgcattccacagcttgtcaaggtattccggaagtcatgacactaacacctcatcattcttcagggcttttcacgcaccaggagctcagcttagtgcgccatctatgctgcatcttacacattccatgaaataagtacaatttttagcctcactctacagataatgaaatcgagggtgaacagagaagcgtctgaaagaatttgaaactatgacataatcaatactttgagtgccaattcccccagagcaactaggagcctcccgcagtctcctgagatgctctgctctttacagactggctttaggagtaggatgtctgggtcctggagagggaagtcataaccaccacccatccaggactyctcagggcaaggagcaccaaataccctctgcacaggctcccaggcctggcatatgcttgggcccagcacccctccagccctggcccaggcgtagggacactcatccaggtggttcagccactgtttattattaactgtgcagcagtggtgaattactcagcaagtaaatccagcttgagattccaggaaagtgaggcacccataaatatctacttttttgagacggagtcttgctctgtcacccaggctggagtacagtggggcgatctcggctcactgcaacctctgcctcctaggttcaaatgattctcctgtgtcagcctcccaagtagctgggattacaagcacgcaccaccatgcccagctaatttttatgtttttagtagagacaggatttcaccatgttggccaggctggtctcgaactcctgagctcaagtgatccatccgcctcagcctcccaaagtgctgggattgtaggcatgagccaccgcacccagcccattctctctctttctaacaaatatacattattattattattactaatgttttgagccagttgacagtagattgattgtatcgttcccttaccccttgatactttagagcattttccctaagaacaggatttttttttatgtaatgtcaatggagctatcaaattcaggaaatttaacatggatataatactttagtctaatttgccgtgcctactctgattgtgtcaattattccgataatgtcttccatggaagtctttttttctctaatgcaaagcccagtccatgactgtgtaagacatttatgcatcacacctctctagcctcttttaatctggaaaagttctcagcctttatctttcatgacattgacatttgtgacaattatctatagggtattcctaaatttggtttgtctgatgtttcttcatgataccgtagccttctgagtttcatgtctggaggtatttaatgcccgtcgcctctcagtggtgatgtccattttgatcactgggtcaaggtgttgtctgggtctcttgtgtagtaattacttcttcaccttgtaactaatacataacmtgtgggagatgttgtaaagtcatataaatctcctactcctccttaaatttcctttctgcctagatttgttatccattgatgattcttgactgacccaatctttactataatgtttacaaaatactggtttttctagttcaccaattcatccaaatcatcagttggcactttgctgtaaggaatagccattcctccaaggcaggcggatcacttgagaccaggagtttgagaccagcctggccaacatggcaaaaccctgtctctgctaaaagtacaaaaaaattagctgggcatggtggtgcacaccgtaatcccagctactcaggaggctgaggcaatagaatcccttgaacctaggaggcggaggttgcagtaagccactgcactccagcctgggtgacaaagtaagactctgtctcaaaaaaaatactctaaaaaacaaaaaagcaatagccattcctttcttactctctttatatgtatatatttataaatatttataccgaataggtatataataattttatgtacatgtgattatgttcacaaaaaacttaaaaaacatttatttatctgatattatcagtgtagaatcatggagtcctatttttgtagttcatcactctatttacttgtttaatttttttttggagacagggcctctttctgtgactgaggctggagtgtagaggtgtgatcatggctcactgtagcctccaactcttgggttcaagtgaccctcttgcctcagcttcttgagtagctgagactacacaggcatgccaccacacccagcttaactttttatagagaccgggtctgcctgtgttgcccaggctggccttgaactcctggcctcccgtccttaattattttgatgctcaaattgtcctagatttgacaagtcaaagcccattaacttgttgctgtgtcattttaacataccttcattgttttttgagtaatgttttacttttcgatacaaaaatatgtcctacgttcatcttgtactttccctgcctcagccctgaattcatttccccaaggagsccaggttcttgttagtagggaatggtgtttagaaaccaaactatggggccgggcacggtggttcacgcctgtaatcccagcagtttgggaggccgaggcaggcggatcatgaggtcaggagattgagaccatcctggctaacacagtgaaatcccgtctctactaaaaatacaaaaaaatgagccaggcgtggcggtgggtgcctgtagtcccagctactcaggaggctgaggcaggagaatggcatgaacccaggaggaggagcttgcagtgagccaagatcatgccactgcactccagtctgggctacagagcaagactctgtctcaaaaaaacaaaaaaaacaaaaaaaacaaaaaactatggggactcaatgtgctctttgccattggggtcaccttgtttccctgccatcttgatgacagagctaatacacacacacaagtttgtactgagacctccacttccagcccaactccacgggatttttccctgcttgccccattccatacatgtattcttctttcaaagtaagaaatttgtctccccctattatacaaataggtgaaacacctattttacaaatagattaaaaaatttacttacttgtataattctataatacttacccatgccattataaaaaacaaagctaccaagaaatattcaagacttttcagttctttttcccttagacttaatgaatatagccaaatactgtatctagaaattaccgtacttccattagttcttttttccacctttagtgtgattatgtaatgcatgatacatttgaaattcatttgcatccatttgtggggttttttttttttggcatttagttttagttttttttctccattctggctaattatcttagtctgttcaagatgccagaacaaaatactacagattgggtagcttaaacaacacatatttattttctcacgactctggaggctgaacgtccatggtcaaggtactgttgagggttggtttctggtgaggcctctcttcctggcttgcagacagccaccttctcagtgcgtcctcacatggcctttactcagtgtgcatgcacagaggaagagagccctgatgtcccttcctctttttataaggaaaacagtttttcagattagagcccccactcttatgacctcatttaaccttaattacctccctgaagatactgtctccaaacacagtcatattaggttaggacttcaacatactaatttgactaaggtggggggactccattcagcccataacactaatataatttatttttttaatatataggacattaccacctaaaagtcaaaattattccaaaaggtgtactcagaaagtgtcaatccctccagtctttctaaccctccccctctcccacccctaccactcgtaggtaaccaattttaatgccttctggtttgtctttcctgtgtcttagtgttttttcctcaaaataaatcgcttatgtgttttcttatttttcccttttctattatatgaaaggcagcacactatgtattcttttttttgcgttctcctttttttctcaataatatgtcctgaaaattactctactagttcacagaatctttccttattattttccacctggtggtatatatatatatatatatatatatatatatatatatatatakayayacacacacacacacccacacacaattttgtatgtgtacacaatagtgtgtgcgccatattttattccatctcctatgtttaggtagttttcagtattttatagttataaatagtgctgtaatttgcatgactgcatgtttataatgttgtcattaatctttagagtcaattcctagaagtgggactgttgggtcaaasggtttattgtacttttaaatgtatattttaatgatttacatcagtttctttacttcgaataataattgggtaagcgaatgatctctttagttttaggatctctaaatttatcaatccactattgtgtgtgtgcagagagggttatcataccaaaatgatccaatctattacaagatagaaagtagtaaacaccatgaaggattaggacatagtgttcaggatgtctggaagagagagaagccccagctactgagtcagggagctctctagaaaagaaggagccatttaagcttgactttaaagagtgggtagaacatggaactatggagaagctcagaacgtgtagtttaggcaaaggcaataatgatggctgaggcactgctgggatgcttggaaagagggtggggcgaccaagtttagatgagagtgtgtcctgacgagagtgggtcctggatgtttaggctgtattttaaccctgcttcttctaccttagttcagtgtggctcaaaatgatcagaatgaagaattcagaaagcttgagaggctttctgagttatggcttctgtgcttgcttttgggattcggtgctctgcctgtggttctcccaggacaaatattagtaccagggagatctagtggaaaccaggagtccagacatctattgtccaaccctgaccttgctaccaatccactctgaccttgttgatggtcacgtgaasgcaggaaccatggctggaatatgttgcttctctatctgtgactattacagtgcctacctttcacacaggaggggtcctgcctccagcttcctctgtggcatcagacaagtcactttctctccctrtactggggttcctggtctctgcagtaaaggagatactgtagatggtctctaagcccataattgtaytttctmagattctgtgaaaataggagagatgtatgcactgtacaaatggacattttttgttatccatgttctcagagtgccaaggggactcccctctttatgcttctcaaagacccttacatcctggtggctgcaggtaagctggcgatgacctcccattgggcggggagtgtctgggcttcaagcagccacggctgctcacagaacwgtctccccagggtccatctgctttgccaacatgggggtggccatcctggagcccacactgcccatctggatgatgcagaccatgtgctcccccaagtggcagctgggtaagtgacctcagcacccccgctcagggcctggcaggaggaggtgggtgccatgagtcctttcgttcartgtcacacagggacaacatgcttcctttgtagaatgacctcccacgtccacacccatgaatcaagcccaagagggtgtgtggtccctcagagaagcagtctgagaaaggggagggtgagagaggatgaaaggggctatggagaggtcacatacctagctgtgtagtaggatgattaatgatttccagtccaaagattcaggttttggtttcagctcctttgattttctgtgaaaacttgtgcagatgccttaaaccctctgagcatcacttttctcattgctaaaatgagcatcaaaatactatstagttcaagagaaattggatgaataaatgacatatgaggtgaaaatgctttgtaccctgtacaatattaatgtgcaccattaccatccacattctcctcccttcagctcctcatcytcaagactaccctttggttatcttttttacctctaaaaaggggtgtatgtagcactcacttaggaaaagctatgggcccaggagagagggttccagcttcctttgttcatgcagcgacttagagaggagcttggagaggaggatctagcccttcccaggaaccctgaggaaagaggacagggaaggctacgtgcaaattgctccatcactgcagggaggagaggcttacggrgccagaggggaagctgataagaacatgatatagttcagcatgcaataaaaagcactaaatctaattttgggggggcaattctaagcaagactcccagctgcactcctagtgccaaattgaatttttatgggttgcargtgcttttgaccatgacgattaattgagttagtcggtattcagtgcagataattcatcgcctgccctaaggctctgaccactcagggtctcgatactagtgagcagctacaacacagagcagctcctccccagcagcctagggaccattctcagttgccagttaccaattactcagttaccagtcactcagttgccaccatcttttacagctttctcaatgctatctggtctgtaaagtctgacatcaaaggttgtccaacaactacatcagaatcacctagagagcttgttaaaactctgattgctgggagacagtaggcaatttagtcaaaacaagttttcatccctagtaagtctgcaggtgatgctaatatagctggtcagtgatcacacctagaaaatcgctgctgtacatgaagagcatccctcaaaggtgttgggagccaaaggagtccatgcttttgaaagtaatgtgtagtctgcctctgagtgcttgctatgtggcccaccatatactaggtagcatcaccaaggggaggaaatagcccaggtccacctgggtttgaatgctgaccacgtcacttactgattgtgacctcggataagttatttaacctctttgacctctgatatggtgtgaatgtgtcccccaaaatttatatgttgcaaattgaatccccagtgcaacagtcttgagmagtgggacctttgagagatgatgagatcatgggagcaccctcatgaatggattaaggccattatcatgggagtgagtttgtcataataaaaggggagttcagctccctttacatctctctcatgtgtgctctctctccatgtgaccccctttggccatgttatgatccagcaaccaggcactccccaggtggccaaacagacactagaggcttgcctttgaacttcttaacctccagaaccctgagccaaataaatctctttcattgataaatcatgcactctggtattctgttatattatagcagcagaaaatggactaagacagaaaatgggtaatgagaaaccgggctgctgctataacaaatacttgaaaatatggaagcagctttggaactggaaaattggtagaggctgcaataatttggaggagcaggctagaaagagcctgtattgctgtggttaaggcattaagggtgattctggtgagggctcagaagaagaggagagctatagagaaagtctgaatctttttagacattggttaagaggttgtgaccagaatgttgatagaaatatggacagtgaaggtcattctgacgaggtctcagatagaaatgaggaacaaggtattggacactagagtaaaggccatccttgttatacagttacaaaaaacttggcagacttgtatccataacctaggacttcatggaatgaagaacttagaggcaataaactaggatatctrgcagaagaaatatctaagcagcaaagcttcaggctgctttgtggctgttttaactgcatatatagtgacatgtgaaagcaaagaaatgatttaaaggtgaaatttatggttaaaagagaaacaaaacagaaagacttggaaaatttgctgcctggccttggaaagaaagaaaaggcatctttaggagagcacaccaagactgtggccaagcaacctaaagtgattagtgtggataaaagtgagccaggcaccacttattaagactgtgggagaaagacccaaaggcattttagagaccttcgaagctgtgcttcccattactggcccagagatgtaggagggcagaatggtttgggaataagcctgggacaccctccatgggctcactgcccaggaccaccttgggactctgctctctgcgtttcagtgcagtgcccctcaactgtgccagccgtggctcaagtgggcccagatgtggcctggcctcccactctggagggtgcaagtggtaagccttggtggtgtctatgtggtgcaaattttgcacgtgcgcagaatgcaagagctatgggtgcatgacttcttccacctaaatttcaaaagatgccatgcacagccacttccaagatcacggaactgtaggggcaccagcatggtggcctgcaagcacaagactccaacccatgattgctgctgggtagactcagcccggaaagaccacagacatggggctgcctgatgccttaggggtccaaactccactccagtgtgcccaggattttggacatggagtcaaaggcaattattctccagctttaagacataatattgttttctgttttgggctttggactttcrtgggacctgttacccctttcttcttccctgttgcttccttttgaaataagaatgcctgttctatctttgttccaccattatttttgaaagtaggtaaattatcccttggtgtgcataggagagtggttctaggactcctcacggataccaaactcaaaggatgttcaagtcccttacatagaatggcatcgtatttgcatataatctacacacgtacttccatgtactataatcatttctcaatgacttgtaacacctaatgcaatggaaatgctatataaatagttgttatactgtattattttcttttttgtattatttttatcttgtattgttatttttattttttttcctcatatatttttgatctgcgattagttgaatccaaggatgtgaaacctgcaaatacaaagggccaagtataatttgttttgatttcacacgctcacagctggagggaatttgcctcaggattaatcgtaccttgaatctcacccataactaatttagacaagactctggattttggacttttgagtttacactggaaccacttaagacttctgaaactattgggatggattgaatgcattttgcattgtgacaaggacatgaattttggaggccgggggtagaatgctatgtcctccaaaatttgtgtgttggaaacttaatccccaatgcaacagtgttgagaagtggaacctttagtaggtgataaagtcctaggggcaccacmtttatgaatagattaaagcaattatcataggagtgggttagtcacaaaaggggggagtttggcccctttttcttttctctctcaaatgccctttctccatgtgatacccttcggctgtattatgacccaacaagaagtccctcaccagatggccaagcagatgctggtgccatgcacttgcgattcccagcttccagcattgtgatccaaatacatcttttttctttaagaattacccaatctgtggtaatatgttacagcagcaaaaataaaacagactaagaccaacttcagttttttaatttgtaaaaaagtagrtatttttcagagtcattttcatctggaatcctaaatggattagcccagtgcgtggaatacaggatactatcagtaaataaaaaattatttgtacaattttactttaaaccattttgatagtcacaaaatgtgtaatccctcaccccttagagattcactgtgaaaaacagatgtttttcatgcaggggtcatgtatctataaatacatattctggagcacctattttgcacaaaatactgctaaaatgtaagctataatcaggtcctaaagaacgagcaacgtggattgagaaaaatctaattaaggaaattttacaccatttaaaatgatgtcaaggaggtgtatctaggaggctgtaggcttcctagaggtgcttacttccacatactagataaacaattgagtagttttaatttttttaagcaattaaatataaacgaatgggtacagtttgcaacagattgccacctgtccaggatagcctacacaaatacactaaggtgtgcttacttctactccatagaagagaatattaaaagcaaacaagttgtcagccaataaatggttgattgttgacttttaatttaattgtaattgccatggtattttttgttagcctgcactgtttttttctaggtatagagagggattaaaagggctggtgagatccagacaaactcactctgctgatctcaaacagttccttataccagagccatctgtgctaccacgctgggggtgtggcatagtggaaacacttggagttagagtgagatggcctggactcaagtcctgacatgccactcacgagttatgatgataataatcaagaccagtgcttgtagggcccttactctgcgacaggcacgatgcaaaatgtttgatatgcactattttgtttaaacctcacaactggcctgtctggtagaaattatgattatccccatatttcagagatttcttttcttttctttttctttyttttttttttttggcagctgcaagatttaatagagtgaaaacagagctaccatataatgggaggcggcccaaagggaattgccactgctggctggaatgcctggggtttatatcccgatcattgtccctccctctgtgctctcaggtgatagattatttgattatttctttacctcctgcttttagcctaattggtattttagtgagctctctttactatgtgattggtcaggtgtgagctgagttactagccccttgtttaaaggtgggtgtggtcaccttccccagctaggcttaggaattcttaattggcctaggaaatccagctagtcctgtctgttagtaccccctctcaacaggaaaacccaagtgctgttggggaggttggctgatgaccgctctaactgcttcctgccgaactggggcatagtaggggtcatgcagttgaaagttccttgagaggggtgctttcgatgtcatcaacattggagcatgggctagcaggccagtccaggggtctgtagtagatcttagtcacagactgcatctggggytccatttgaagaaccatttatagttttacagcttcaattctggaagagacaaacttaaccaggaggttaagatacagagattgaaatgtatagcctaaagtgcagcgggaggtacatccaacagttagtaggattttggccaaggttccatcgagcctagtgagggtggtattaaataggcttaccaggcaagtatgggtacagagggtcttcaaaggcatacaagaattgagagtcaggatgtacagggatgtagaaaaaggcatccttaaggtccaggactgtgagtcactctgcttcctctggtatttgggaaagcagagtataagggttaggtacagcttggtatagagggacaatagcctcactgataatcctgagatcttgcactaacctccactgtccgttgggtttctggactcctaaaattggagtactgcaggggctgttgcatagttttacaaggccttgggcttttaggtccttaacaatcttttggagtccttgttgggcctcaggtctaagggggtactgcctttggtagggaaaggaggtggaatcctttagtttaacttgaacgggacgggcattcttcgctcctccatattgtccttctgttgcccagacttcaggattaattccctcctcaagcagggcacaacaaacaggtgttccttctgtatgttcaggtgtataatggcccctgcttttgcgagaatgtctctccttaacaaagaagtggggccttcaggcataattagaaaggcatgtgaaaagagcaaagttctccagtcacaacttagtggctgggagaagtatctagtgactgcctgtcctaggacctctcagatagtgacagatctggaggacagttgtcagggacaggagagtaagactgagaaggctgcaccagtgtctaggagacagttaacctcctggccctcaaaggtcaagcatacccagggctctgtgagggtgatgacatgggctggcacttgccctgggcaccctcagtcctgctgctggatcatctgttagtggcttctgactcagaggaccttcgtcccctgggacagtgggccttccagtgattctcttgacataaggggcatagatgagggggtggcttayttctattcggacaatcttttttaaagcgtccttgtagactgcactagaagcaagccctattaggcatttgatttgcccaggctttccatattccagagcctccaaagtccacttgccgagggacatggctaaaggggtggccttctttttctcccgttcgtcccattccacctgctcctcctgatctctattataaaaaactgaggttgccaagttcagtagggtttctaagttttgctctgggcctaaagtggacttttgaagtttgtttctaatatctgcagctgactgagtgataaacttatcttttaagattagttggccttcaatagagtcaggtgacagagaggtatgcttcctcaatgcctcccttagtgtctccagaaaggcagtaggattttcttcctttccctgtgttataatggatatcactgagtaattcatagccttcttcctagttttccttagtccttctagcacgcaagttagcaaatgtctgcggcaccaatctccatgttgtgattctgcatcataatgagagtctacactaggaactgcctactggcctgtggggaatcgttctctttcctctgttgtcaccctatcattgacctgactgagataccagagatcgccaaactctcaggctgcaattatagctgcccttctttcatttggggttagtgtctgatctagcagtaacattatatctctccagaatacatcttaggggcgtttttgccttggggaaaacgtttcccatctgaaaaaagaacatgaggatgccagcacccctagtcattttccgatgagcattagtcctagagtgtcctctatggtcctaatgcttattcctttccagggtgtgtaaccacccagggacatctgcttaccggattagttacrctcaccgatgtagcagtcctgcacctgttttcccgcctttcttgaccacaaagaaaggagtccaggctgctggattmtggtggtccattaccagcgtgcccaacattgcctttgcgatcaggggtgagttcttgagctgggctgcgcaacccagttgccccatcaagatgcattcccataaacaacaattcttatgcaaattcatttcagagagggtgtaggtaaccctttgagtcaggattgagatagagtttttgcccactagggcatttgtccttttcctttgtaggaatacaccctaattattgatcttaaactttttgttgccccggattaagtccttttgggtaagaaatatgagagatggatcctgtttatcctgtgtgcctttttcctaaaagaagaagagcaaggagaaaaagatgggcttactggttttgtaagtactttaaggcttggctgaatgcaaacagctcacacctttgagcagaccaattattaggcaattttcccaactctgcttctacaagagtttccttatcaattactgaatacccattacggttttttccctcagtcacccgggaggaaccatctatcttcctgtccttaagggggtacctcctgagtctggtcagaccttcgtatggtaattaagattaaaatcccctgttaggaaattggctgggttaagggaattttcagtggttaatgttaagtcatctttttttttttttaacagactagccccatactttaagatttttgagttagtaagctacttttttttttttttttgacttaggatagttctgaactggtgaggtgtgctcacaatgaggtttcctctaaaagttatttttctacttccttctgttagcaaagcagttgccactacagattgaatgcatttggggcatccctttaatttactcaattcactttgatactgatctattatgttgtcgcaggcccagttccagtgttaaagtactgggtcatcagttctaaggccctcgccaaggagctgaggcttggagattgtattgcacagggtgggtaagttggatagaaattgagagaggagagtacttacacaatggcagagcaatcctcctagccatttacaaacttgtggcccttgcaagggtggtggggaacgggtcccacataactgcccatgttgagagctgtatacctaaattgggagggacaccaggggcaagactccgtgggttcatagccttggtgcctaaggacacagtgtagagcttccttagatcccctttggagatacaacttgctctaatacttgggagaggaagtgaaagtctgaagcattagtacctaggaggcagggattggaggaagtagattcagaggtaaggagaattctggggctacactttcaagaaagtcatggttggaacccaggaggtatgggtcagaagaagaggtaggggtgcacacatgggcaactatagagtagagacttctggttgcatcatgatcttgactgatcaatgcccggagtttgggatgacagctttctgcctctagtcggccttcggcttcccccaagaaaattgtgaaagcagaagctggttccaggcagaccaatgctcccatcctagaaggattgggtgttgttagaaagccttttcccagaaagcctcccagctgagtcttaagtccagcagccacgctaatcgtttgtaactggctgacaggtgctcggtattttcctctgattctaaggaaggataggacagaatagcaagcaaaagtgatccaatattactcaccactttggagaagccctgtacaggccaccagatgttactggagggtctttgttcttagagctcccaagatggggcgggctgctcctaagatggcagcaagccttttgttctctgacctggggttcttggcctcacagattccaaggaatggaacctkgggccatgtggtgagtgttatagctctaktagaagccgtgggtcacagawgagaaccgtggaatgcagtgactagtgttcagctggattaggatgaacctgggcacttaggtgtgcaggaacaatggcaagcttttagcccaatcaggagtggcaatgggtgccttgctggatcagaagtgcagtggacaccctgccagatctggaggggtggaagtcaatggtgggtctgtgatggcagcrctcagccgtggtggacggcgaatgaaagctcagctcgagccagaacaaacacggaccagaagagtgtayagttgcaagatytaatagagtgaaaacagagctcccaaagggggttgccctcagagatttcttgatcttaccaaatttcccagtgctctttcaaatcctggacttgtcatcagcaagcatcctatgccctcatccttttctctgaacatgtctttcatcttcttgccctactgagacccagatgttttctgtgaacattgttttcctgcarcatctagatggaagttcatgttccacaccttgctctcctttgttgcttccgagtcatttcttctctattctccttcaaagatctcagctcctttgaatgtcatgtcgttagattacaccaccgaacccttgtttgttgcaaacatctagtgacctcttagttgtccctcctcattcattaaagctgtcaacatctggtccatgttcttttcacctctactcctgtcaccatttttggtgacttcaatatccaggtggataactgtggatcttggcctcctaattttttaatctactcttttgcaatgatcctttcctccttctcaccttaaccaatttaatcctatttatgccctcactttgtgtattagttcattttgcatggctataaaggaatatctgaggctgggtaatttataaagaaaagaggtttatttggcttatggttctacatgctgtacaagaagcctggcaccagcatctgcctctggtgagggcctcaggaggcccagctcttttaacaaccagctcttgtgtgaacttacagagcaagaagtcactcattaccgtgaggatggggacagcaccacgccattcacgagsgattcattcccatgacccaaacacctcccactcagccccacctttaccactggagatgaagttataacgtgaaatttcaagaggacaaatatcaagcaatatcaccttgatgtcagtattaattatatttcctctgaaatctcaattccaaacaatccagttctcatcttacatattcccttctcaggtgttctaatagtcccatatcaacaattttggaccaaactgggatcaccaattcactgtcctgagtaatttttcttccatcactactcctgtcctcacttctttctttttttttttgagacagagtcttgctctgtcgcccaggctggagtgcagtggctcactgcaagctccgcctctcaggttcatgccattctcctgcctcagcctcctgagtagctgggactacaggtacctgccaccatgcccagctaattttttgtattttttagtagagatggggtttcactgtgttagctaggatggtcttgatctcctgaccttgtgatccacctgcctctgcctcccaaagtgctgggattacaggcgtgagccacagcgcccagcctgtcctcacttctttctttcctcaacttggattcaatggctcatgatggatgtcactcttctgaaactcctcactccctctgggcttgtcacttgccaaaaacttcactctagctaagctatcttgttgcctactccttgtctgtaactgagccatggcatggggctgcaaaaaaaaacgcacaaccacgctgttggtctcaccttatatttatggccacaaacctaaagtgggtttcacattgtccaacaatctttctctaagcccctagttatgtcctccttcttcttttccaaaatgactattttatatttcttcattttagccccatatgcactcccgtcccttcaccatcatcattctcagtggttgactttgcctcctactcattgagaaaacagaagctatgataaaatggaagcaatgagaatggaactgtcgtgtttccatcactaagtgtacccaatatcctgcatctgaacccacattcccagtcttctctttaattatggttggagcatcccagccctgatcaaaggccagactcctcttctcgattccatctcccctcacctacttcattggctactcctcatctcctgtgctatctctgccttctttgctaatgtctaaagataggagtcccccaaggctcagtccttggatctctattctttatttgttctttcataggcaatcccatccatttgcatggctttaagtatctaactgcctgacagctctgcttggatatctaccagtcacttcaaacctctcacgttccccccatgctcttgcacttcaaccagtcttccctatctccagctacccaatcgattaagacaaaaacctaggttatccctgatttctcacttcccctcctcactcccgctatgtctttacccaatcaaacagaaaatgtcaccaacttacctccaaaacctaccattttgttcacttctctccaccatgacttctaatctgaggcaccatcacttttctcttggattctgcaaatagtctgacttccactcttgtcccatgaacccattcttctaggggattttagaaaatataaatccaattatgtcatttccttccaaagcttccattgcccttggaataaccagattcatttctaggaccttcattttctcaccctccactttcctcttatatttcaggcacacagatatcctttctattcttagagcaaactaaatgatttctttaagacatcttaatttccattaggtgctttttattttctgcttgaagtgctctcttttggttattaaggtctcagtttgaatgtcacttccccaaagaagccttccccaaccctgaaatcccagatagcccttctgagttgctctgctatatcaccacattaaatttcatgcacataactcaacacttttcaaaattatcttttttgtgtatttgtttacttgttcattgtatgtctccctcccctggagtgtaagctagctgagggctagaattttgtttgtcttattcaccgctgtattcccagcccccagaatacctgacacatggtcaaagtttgttaaaatgaatgaatgaatgaatgaatgaatggaagagactcagacaggttaagtaaattgtccaaagtcacagagctaacaagtcatcaagccatggtttgaatgcaaaatttggagctttgtgtggctccaaagcccatgtttcctgaacacttccctctactgtcacaaaaagccatgtgttcaggacttcaatttacaaaatacttttgcatgcattacctaatttgctccacattgtaacccggtatgatataatcatagctttgctttttccagatgtggaaaccaaggctcagaaaggtttagtaattaatccaagatccctctcagagaaatagaagggctggtaagtagcaaggcaggaattcacttcccaggaattatgtatgggtatgtggcacccaaccacaccacctctgaagctcacattctcacgctgataatcaagggtattttatacatgagaacggctcatcagggccattcattaggaatctaagtggggagctggaagcacattaaatgtactgaggctaggccaggtgtgggggctcacatctgtaatcccagcactttgggaggccaaggcaggcaggatttcatgaccagcctgggcaacatgacgagactccatctctacaaaacaaacaaacaaacaaacaaamaaaaaaaaaacaaaaaaaaacaactaggtgtggtggtgttcatctgtaatcccagccacttgggaggctgagctgggaggatcacttgatcccaggaggtcgaggctgcagtgggctgagattgtaccactgcactccagcctgggtgacagagtgaggccctgtctcaaaaaaagaaagaaaacaaaaagaaaagtactgaggctaaacaaagccttgctcctgaagaaaggagaggtgtgggggtcctatggcaactactgtgggtttgcacaaaggtccccagatcataaaacaaagtggtttggggatcttggaaggttacaggggtggacttcagtgtcttgtacgagacaaggcattttagagtaaattggacatgtcctaaggtaaggatctgtrtccttccacaggtctagctttcttgcctgccagtgtgtcctacctcattggcaccaacctctttggtgtgttggccaacaagatgggtcggtatgtagcctcgggatctggracgaacagtagaaatgtaagatggaagagcgcccgttcctgatcttggaatgatgaacagcttccatacggttgaaagtttaggatgagtacacaccgataaaaacttcccactgggaggatgggcagtgagtgagtggtgagggtggtatggagaatggattgtcctgagctctgagctgattgttatagaagaggcagtggatacatgaggggcaccccttactttccatccatttgctgtccagttgaggagataaaataaccacaacagagaacagctatgaaaaatgcagtactttgggaaagtagttttcaaattatgttctgtggaatcctaaggagttctatagaggcaccccagaggccactgaggaggaagggttgggggccaagagctatgagtctccattctgtcccttcactacaataaggacagctttaattttatctttggagtttagcatcaagattttagaagcactgccataggacatcagagaaggaaagaagtttggtactttctgtgttttttgagacagacctcaaggaccaaataaaataggacaggtaggaggcagtstgagctgggcaacagcatgagttaagtttgagggctacttctaaggaacaagtgcctcctgagtcagctgattcctcctgtaagggaaggaagagtgtgtcccacggcacctcctctgcctttctatagaaaaagggatggagccaggggagacaaggaaagggcagggagagagctcatttgggtacaaactggtcatgtagggatgctgtcctcaggtcctaaggggttgctgggattagggctggtgggacaggtcagcatggcggtgatggggtacaggtggaggggagctctcccctagtggtgtttgatgatggcttttttcttccaggtggctgtgttccctaatcgggatgctggtagtaggtaccagcttgctctgtgtaagtataagaagacctgggggaggggaaggagagagagagcgagagacagacagacagagagagagagagagrgagagagagagrgagagagagagagagaaagacacagacatttaaagactaatttcctttaagatgagcagagatggcttggcaargactgtcagaaagactgtttctgaataggcaggaatttagcacgggggaagaggccaccagctgcagtggctttcctttgaggggaagtgggaaaggagaggaagagggctgtagggcagctggagccggaggtctgaggctgtacatgtgggcatatgaagtgatacatgttggtatccatttctggggatggcaaaatggtgcgttttatgacttcatttactcatcccaccctgacagagcctcataaatccccagggaaccatcatctatgtcccagtctctggcaccagaggcttgatagaagaagaaagaaagaaggacttttccatttccaagaatccccctcaagttctcaaagccttcatttcctcctctccccagtggggatgagaaacacacaaacctcctaggcctgagggagagaagaacagggctacaaggcactgtaaactgtgctcaagaccagctggaggtcctgagcaggagcatgggatccrggttccatggcaggttttgccactttctatgcatgtgactttgagcaggttacttcatctccgtgtgctcagcatcctcatctatgtagagagggttctgatggtgtccacagggttgtcaaggtaatccaaataaaccacagtgtctggcacatggtgagcccatagtgaatctcagccaatactattgatawtttataaacatttcttgaggcatgaaccctaaaaattgttatcagccagcagcatctaaacggtatgctaaacccttaagggktgagtgtcctggggtagcaggtttgaatggcaggtacccagagagggaggtaaggaacctgaaaaagagggaagaaggggtttttgttgggggattgggagggcaatgggaatgagtctcacaagcttcctgacaggggacccaagccacaccacctgccccctctagcttacagctractggttgttggggcctcttctctatcttctttttccaacagctaccaagttagaagtctaaatgaaacctttcagtgatgtccataatggaaaacagaggcaactttattccatgaagaatgagaccaggagtgtatgtttaggtgaagaggggtagaggaaggggagaaagtatccatggaacagaggaagaccctcgttagagcataatggagccaagtctgaggtccaaacttgatcttgccactcattagatctgtaactctggatagagcaataaataaacacaacagcgctggtcaagttttcatatccttaaaatggaggtatagattcttttccatgagaaagtstgagagtgcaggaggatgatgtatgtggccaatagtgcactctgaataaatgcatttcatgtgaaaactctttgaaccttgctcccacctgacccatctggagtcctgatgactcttcctccttccccatgcaggttcctctggctcacaatatttttggtvtcattggccccaatgcagggcttggccttgccataggtaagaagtgccctcaaagaaaacaakaagcccctgcatgttggctttgggtctgatgcctttcctcccccttttctcmtcagaggaggtaggtgcagaggcagaaggatcaggagggcagctggcagggttgtggagagatgagctcgtaattcccacctggaacaggtgttagtcygaggcagaagacagcagacaaagcaaatggactaaakggrggaggagaggcggggtggtactaactgtgggtggggctgactgtgtcctgtttgctctggccacaggcatggtggattcttctatgatgcccatcatggggcacctggtggatctacgccacacctcggtgtatgggagtgtctaygccatcgctgatgtggctttttgcatgggctttgctataggtatgttggcaggacctggtgccccactttyccctgtcyactctttaccagctggaagtgcagccaggaagctatcctcctagggttctggagatctttgacgctgagacatcctctgggtcacccactgcccctagcatagtgtcctacgtggaggatgctccatatggaggctccatagacacttatgactttgatgtatccctcccaggtccatccaccggtggtgccattgtaaaggccatcggttttccctggctcatggtcatcactggggtcatcaacatcgtctatgctccactctgctactacctgcggagccccccggcraaggaagagaagcttgtaaggagcaccgactgttaaaagagaaattcacttctgtttctttccatcatctctctcattccctttcaycctgggctgttatttcctccctctattgctctgttgatactctctctgctttgccrtgtttcccaatcccctttcatcttcatatttcttttgtgcacttccttaatttcccttctctaagtaaccacttccctctttctggggctatcaggaagggtcttcagtagagaagggaaatgggggcagaggaccatcaaagacatcctgtagttactgttcttagcttgctagttactagcaagatgtgagttaccaagttaactccctcataagtgggcagaattccattggcacatccgttcatccactcattcactctagtgcaacattatccttaccaggtcacttttttttttttttttgatggagtttcactcttgttgcccagggtggagtgtaatagtgtgatctcggctcaccacaacctctgcctcccgggttcaagagattctcctgccttggcatcccaagtagctgggattacaggcatgtaccaccatgtcyggctaattttttgtatttttagtagagatggggtttatccatgttggtcagcaggtcacgtttttaaaagtacaaaaaccccagggaagagatccataccataggattttctttaataaagcactttcctcttactgcagcacaaacatcctgagggcctgatgggtttgggataccgacagaggctgctcaagggaacaaaagaagacatgaaggtgtgatagggagtggtggtgattccatttggcttcctgctgtaactttcactaccactgttaaattcagttaaaagcaaatgagatacttgtcctgacaagggttgatatactaggtacccsgggaggctggtgcatgtacatgcagagggtcctatgcatgtttcttgagtacttagcaatgccagccttggaagaactagtgggaggacggaatgaggagattggtaaaaaaaagatgtgcggtggttggccgggcgcggtggctcacgcctgtaatcccagcactttaggaggctgaggcgggcgcatcaygaggtcaggagatcgagaccattctggctaacatggtgaaaccccrtctctgctaaaaatacaaaaaattagcctggcgtggtgatgggcgcctgtagttccagctactctggaggctgaggcaggagaacggcatgaacccgggaggcggagcttgcagtgrgscgagattgcgccactgcactccagcctgggcaacagagcgagactccgtctcaaaaaaaaaaaaatgataataatgtgcagtggcttctcttcttgcctctctctgcaggctattctgagtcaggactgccccatggagacccggatgtatgcaacccagaagcccacgaaggaatttcctctgggggaggacagtgatgaggagcctgaccatgaggagtagcagcagaaggtgctccttgaattmatgatgcctcagtgaccacctctttccctgggaccagatcaccatggctgagcccacggctcagtgggcttcacatacctctgcctgggaatcttctttcctcccctcccatggacactgtccctgatactcttctcacctgtgtaacttgtagctcttcctctatgccttggtgccgcagtggcccatcttttatgggaagacagagtgatgcaccttcccgctgctgtgaggttgattaaacttgagctgtgacgggttctgcaaggggtgactcattgcatagaggtggtagtgagtaatgtgcccctgaaaccagtggggtgactgacaagcctctttaatctgttgcctgattttctctggcatagtcccaacagatcggaagagtgttaccctcttttcctcaacgtgttctttcccgggttttcccagccgagttgagaaaatgttctcagcattgtcttgctgccaaatgccagcttgaagagttttgttttgttttttttcatttatttttttttttaataaagtgagtgatttttctgtggctaaatctagagctgctaaaagggctttaccctcagtgaaaagtgtcttctattttcattatctttcagaaacaggagcccatttctcttctgctggagttattgacattctcctgacctcccctgtgtgttcctaccttttctgaacctcttagactcttagaaataaaagtagaagaaagacagaaaaaataactgattagacccaagatttcatgggaagaagttaaaagaaactgccttgaaatccctcctgattgtagatttcctaayaggaggggtgtaatgtgacattgttcatacttgctaataaatacattattgcctaattcagacctggtaaactagatgttgttttatagcacaagagagtgtatgggcaaatagagcaaatactataaatattatcacactttcctacctttttgaaatacttattgggtgatgggatttcaaagaggtgggagacatggcatccccctaagtagctccccatctgtttgggcaaacagggtgtgaacagtgtaaaacatgattaatgctgcaagttagtatacattctgtgttcaagtatgaacaggtgggatgctcataggctgggtgggaaataatggcagagacagaggtaagaagcaggatggagagacccacacagacaggcttttgggatgcctgaatatcagattggggttttcagactttatctggaatgacaccagggtctgatttttgcactgctctgtaggagtctgaggctccaacacaaaccctgaatcaaagagcacattcaagctgaacctttcaatgaatcttcaccatgcaaatgatagatacctgacttatggatatgtttttagggggctggcattaactagactacctgatttccaaaaccagatgtgttataatcatctttggtcaggatgacatctttctcagactttgaaggagctcaaaggtgaaattataaaattgtttgtcaaaatatataaactgtaagtacacatgcagagtgaatgaatgaccattgggataccttacacaggtggcagtggggtggggcgggatgtggagctctggcaatgacagcctgctgactctgacatccacctggggcagggcttataataaagactgggcttgctacagaaatgaacacatttaaaaaatgggaacaattttttgtcagagaaactgattcctggcttgccagctaacattgtttgaacaatatgcaaagatgtagataaagggaagccagtggacacaatttgagacttttaaaacaattcttgtcaagggttaacaccaggccgggcacagtggctcatgtctgtaatcccagcactttgggaggccaaggcaagagggtcattcgagctcaggagttcaagaccagcccgggcagcatggcgaaactccttctctacaaaaaatttaaaaattagctaggcatggtggtacgttcctgtggtctcagcttctcaaagggctgaggcaggagaatcacttgagcccgggaggtggaggctgcactgggccatgatcgtgcaaatgcacttcaacctgggcaatagactgagaccctgactcaaaaaataagaagtcaacaccaaacactgtaaagtaagtcaggacactttttaaaattatagatcagaggtaggttaaagatcatatatatagcgtatatatggaagagtataaaaagaagaattccacaaaaataggaaatggaattagtctttattagtggccttataaagaaggccactaatataaagaagagaatgcacggtaaatttcccatattcacaggtcagatgaatttcttgtaacaatgaaaatgccacccagcaaggatgagccacaagaagttttctatgaaagtatcataaaatggcactccactccactgtgggacagttgaagagatgcgtttttccctcatgaaagggaggaggtgcagagactataaaaatctttgtagaaagacgggctttcaaccaccaattaccatgtagcaaagaagacagtgcaactaacgagctatggtgctcaataagccaggaaaatgttggagtttatcagagcattagaagcaaaccagaagacacatcctttccaaagtacaaaagcaggaaaagtgtggcagttccacattagggtgggagctacagcaccttaaattaaggaggtaactatggaggctgaaggaatgcagagatcacacaggatgatgaatgggtggcaggaacagcagtgtggcaagtgacaggaaagttcttatggggagggacccaaattcaaggggatgttattaaagtagcctacacctttaaggaggcccatttgtgatggccacagtctcagaacaccactggaggaactctaaaatcactagagggctaactctagggtgaatattaggaaatacttccccgctacccacccactgtgttcttatgtatggaattgatttttccaagataaagccttagctacataaaataatttttaaaaaaattttagagacaaggtcttgctctgtcacccagactggggtgcagtggtgcaatcatggctcactgcagcctccacctcctgggctcaaacaatcctcccatctcagccttttgagtagctgggactacaggtgcatgccatcacactcagtttatttattttttaaattatttattattattattattatttattattattattattattattttgtagacacagggtcttgctttgttgcccaggcttaaaataaatttcctagtaacattgctccctactcctggaggtagctctgtaatgcttgtacgagtcagtcctctgaggcttacttgaagaaagggcggtgcagcccttccacacaccttccctggatgtgtggttgattcttggcaagctttgacaccccagggctgctgcgttacacaattcagttctgctgagctcacccctacaatttcgtgtatgggacaggagaactttctctgcaacaaggcaggaatggagcatggtggctttggtacaaagcgctctctgctgtttctgggaggtgctgaagagagaaatggtcaagtcacaaggtggttgagggaggaccaaatcaggaataaagagacataatcctgaggtcctagcctagctctgacattaactagctgtgtgacctgggacaagtcatttcacgtctctgggctttggcatcaacttctgtagctctggctttctgtggctccatctgccactggctcattttggggtggctttctgtgagctcaggggcaggacctgagcgaggagccaaagacaaagctgagaggtcagacaaaggtgagaaccagcatcaccccagaaacacaaacgtcatttcaggtttcatttgttgctttcaagaaattattagaagcaaagtgtgttgtgatcccctcccctcctccttgccctccttgttgtcctccttctccttatcttcttcctcctcctctcctcgctcctctcctcccctgctgtcccttctccccctcccccctcctcctcctccccctcttcttcctcctcctccctcccccccttgtcctcctctcctcctccctgcttcttcttccccttttttctttcttcttctggagaatgatgagtacagtgttagcagaggcatgagcgtggtcaaggtcttttaggatttgtcatccaaatcgagtcattatgtggtctctggaaatcataagggagaagagtgcagtttggggatcatacattgcttgttttggctattgaccccaggtcagtaattgacaatttttcttcttttctttttcctttcctttcctctcctctcctctcctctcctctcctctcctttcctttcctttccttcttttttttttttttttgagacagtgtcttgctgtgttgcccaggctggggtgcagtagtacgatctcggctcactgcaacctctgcctctcaggttcaagcaattctcctgcatcagtgtcccaaggggtagctgggattacaggcatgtgccaccacgcccggctgattttttgtatttttaagagagacagggtttcaccatattggccaggctggtctcaaacacctgagctcagtcaatccaccggccttggcctcccaaagcgctgggattacaggcgtgagccactgcacccagccagcaattatacctattaggtagaattagggtgtgctgaggggcagccgaccatggtgcaggtcacaacaggttgctgagcaaatcgtcacaggaaagcaggaagttttgtgtgttcaggtgtgactcaacgtgcaggtggcctggtgctcaaagtaggtctgccatgatattcatggaatgacagggagcgggtgggggagcagtgttacagtgttgcaaaccaaagccctctggggaatctccacaacatagaaacaatgtgacagtgaaaactttgttatttgtaacgtgagaataacaatgacacagttgtaacaggagtgtaattaagatgaatgaggtaataagaagtagacaaagaacacactttatcaaccataaacccctatttaaggccagatgcagtggctcacatctgtaatcccagcactttgggaggctgaggagggcggatcatctgaggtcaggagttcgagaccaacctggccaacatggaagaaaccccatctctactaaaaatacaaaaaaattacctgactttggtggcacacatcagtaatcccagctactcaggaggttgaggcaggagaatcacttgaacctgggaggtggaggttgcagggagccaagatcacaccactgaactccagccttggtgacagagtgagactgtctcaaaaaaaacagaaacaaaaacaaaaacaaaaaccccacaaaacttgtttaagtgctactttctattatcagtgagttcaattctcttatcctacagaagaggaaactgatgagatgggtctcactatgttgcccaggctggcgttgatctcctgggctcaagagatcctcccatcttggcctcccaaagtaatgggattacaggaatgatccactgccaccagccaaaatccattttttttggtaacagctttattgagatacaattcacatgccataccgttcatccatttaaagtatactattcagtggctttaagtatattcacaggactgtgcagccatcaccaccataaattttatattttcatcagcccagaaagaaattctgtgcccattaatcatccctgaattttctttcaacaacaccctccagtcccaggaaaccactaatctttctttctctatagatctgcctattccagacacttgacataaatggaatcatacaatatgtggtcttttgagactggcttgtttcactaagcatgttttcaagatttatcagtatactatcacatctgggattaagtaaaaattaaaaaaaaattaaaggttcatctatattgtggtatgtatcactacctcttttctttttattattaaacgatgtcccattatatgaatatattacaccttatttattcatcttatttcattcatcagctcatgggcatttgcgtcatgttcacctttcagctgttgtgaataatgctgctctaaacatttatgtataagttgttgtgtgggcatatgttctcatttctcctgggtatatacctaggagtaaaattgttcggtcctgtgataacttgatgttaaaactctgaggaactgccagactgttttccaaagtagctttcatatttccacagtcagtggatttcatatttccacagtcggtggatgaaggttccaatttctccacatccttgccaacatttgttattgtctgtctttttaattatatccatcctagggggtgtgaaatggtcgcttgtggttttgatttgaatttttctgatgaccaataatgttgagcatcttttcatgtacttattgaccatgtatacattttctttgtggaaatgtctattcagagcctttgtccattaaaaaaaaaaaaaatggttgtcttggccgggctcggtggctcacgcctgtaatcccagcactttgggaggccaaggcaggtggatcacgaggtcaggagttcaagaccagcctggccaacgtggtgaaaccccctctctactagtaatacaaatattagccaggtgtggtggcacgtgcctgtagtcccagctactcgggaggctgagacaggagaatcgcttgaacccaggaggtggaggttgcagtgagccgagattgtgccactgcactccagcgtgggtga

SEQ ID NO: 17700 - DNA, 30192 bp, Homo sapiens
  misc_feature (1)...(30192): n = A,T,C or G, or insertion/deletion polymorphism (see Tables 1-2)
tactcctgacctcaggtgatcgcccacctcggcctcccaaagtgctgggattacaggcgtgagccaccgtgcctggcctgtttccagtttttggctattacaaacaaagctgctgtgaataattgtgtgcaggtttttatgtggacatacgttttcatttcttagggataaaatgcccaggagtgcaattgctgggtcatctggtaggtatattttgtttagtttttcaggaaaccggcaaactgttttccagagtagctggaccactttgcatccccaccagtcgtgtgtgaatgtttcaagttcacagcatcctcaccagtgtttggtgttgtcattattggttatttaattttagctgttctaaagcggtatcttgtcatgggtttcaatttgcatttcactaatggctggtgatgtgagacatcttttcatgtgcttatttgccttctatataccttcttcagggaaaggtgtcatcatgtcttttgcctattttctaactggactgttttttatttatttatttatttatttatttatttatttatttatttagagacagagtctcactctgtcgcccaggctggagtgcagtggtgggatctcagctcactgcaacctccgcctcctgggctcaggtgactctcctgcctcagcttcctgagcagctgggattataggcgcacaccaccatgcctgctaatttttgtatttttagtagagatggggttttgccatgttggccaggctggtcttgaactcctgacctcaggtgatccactttgcttcccaaagtgctgggattacaggtgtgagccatcgtgcccagcctgatttttattttatatatatatatatgtacacacacacacacaatatacatacacacacatatatgcacacatatgtgtgttaaagctgtatgtaaagctgttatatattacatatatactacatatataacagctttgctgagatataattcacataccataaaacacacccatgtaaaatgtccaattgaatggttttgggtctattcactgaatkatgcaaccatcaccacaaccagttttagaacatttcatcaccccaaaataatctcacatccattagcagtcactcttcatttcctcttacctttcccaccccaccccagccctacgcaaccgctacatctacttctgtctctacagatttgccttttctgaatatttcacgtgaatggaatcatacaatatgtgacattttgtgattggcttctttcacttaatgttttcaaagttcatccatatccaggcgccgtggctcacgcctgtaatcccagcactttgggaggccaaggcgggtggatcacctgaggtcaggagttcaggaccagtctggccaacatggtaaaaccccgtctctactaacaatatgaataattagctgggcgtggtggcggatgcctgtaatcccagtcactcagaaggttgaggcaggagaatcgcttgaacctgggaggcagaggttgcagtgagccgagatggcaccactgcactccagcctgggcaacaagtgaaactcggtctcgaaaaaaagttcatccatgttgtagtatctatcagtacttcattcctttttattatcaaataatattttattgtttaggtctcccatattttctttattcattcatctcttcatggacatgtgggttgtttctgctttttggctttcatgaataatgctgctgtaaacatttgtgttcaagtttctgggtgaacatgttcttatttctcttggttatatatgtaagagtggagatgcaggagtgtatggtaattctatgcttaatctttggaggaactgttttgagacttttttccagagtggctggacaattttatattcacactagcaatatataaatgatttagtttccatacatctttccagtatttgatactatcttttattttagctgttcttatagatgttagtagtgatatctcatcatggtcttaacctgtctaaaggctagtgatgttgaatatctttttagataattattttctatccatatatccccttgggtgaaatttctctttatatcttttgccagtcttctaattggatgatttgatttttttatgtagtgtttctatgttgaatttgagagttctttatatatttgttctagataggagtcctttgtcagatatgtggtttgcaaatattttctcttagtctgtaatttgtcttttcattctcttaactaggtcttttacagagcaaaaaaaaattaattttgatgaagttggattgatttttttagggatcatgcctttggtgtcatgtctaagaacacttcatcaagctctaagtctcacagattttctcctatgttatcttccagaggttttttgtttttattttattttactttttaattaagacagagtttcgctctgttgcccaggctggagtgcagtggcaggatctcagctcactgcaacctccgcctcccaggttcaagtgatcctcctgccttggcctcctgagtagctgggactacaggcacgcaccacccaactggctaattttttgcatttttatgtggttgctttcgagaattttctctgcctcttgtttttagaagtttgactatgatgtgtcttggcatgaatttctttgggtttatcctgtttgtgatgcgctcagcttcttgaatctgtagacatatgttgtgcgtgtgtgttgtcaaatgaagataatttgcagccattacttcttggaatatttttttaaggcccaccctccttttcctccccttctgggacttcaatgacaaaatgttagatcttcttttattatagttactcatgtccttgaggctttgttccattttctttcatctattttctttccattgttcagaatgggtaatttctattgttatacgttttgtttcactgcttctttcttctatactctccattctgctattgagcccatccattatggtttttatttcagctcttgtattttttagttgtattttttagttctaaagtttccatttggttcttctttatattttctatttctttgctgatactttttattattttatttgtttcaagcacatttataatttctcagtgaaacacttttatgatggctgctccaaaatctttgtcagataattctaacatctgtgtcgtcttgatgtttgtgtctgttaattatcttttgttattcagtttgagaatgcctgattcctagtatgacaagtgatttgccattgaagtcaggatattctgggcactgtgttataagattctggatcttctttaaatattttgttttagtgggcttccctttatactgctccagcgaaataaagtagggcactgcctgattgcttccagacagggataaaagtccaggttctccatccagcctttcctgaacctggggggttgggagagatgaggcctccatgttattgtttggtaagggtagaagttcaggttccccactaggaatccatgacaactccctggctgggagtgggagggatgcttcattactgctccctatgtggctttcactgacactgtgtgtggcagagagaggggggtgcttgttaccactgagtggtggcgaaagtcccaactctccaccaggccccctttgacactactccaatggggccgggtggaatgcctcatttctgcattggggtggcagtggatgtccaggctgcccacatggtttccaccaacaccacatcgggggagggtgatcccagtggggaggaatgtcccagctccaactctagcatcactctggctgagtatgggagtggcctagggttctttgttacagcctggtgaaggtgaatgtctaggttttccatccggcctttgctgacaagggtgatgatggaacttggatggagcggagcaggtatggactaaaagagctctgtctttctaggatgcccctttcctcgttctttggctagaaaagcatagttttgctagaacttgttctgttgggactttttcttgtttgtgccccttggcattttcagttgttggcttctccagtattcagcctgagatatatgaggcaaagagaaatcccagggaattcaccaccattccttaagtcccgaggttcctaaccagtctgcttctctccatctttcagtcttcttatgcttgtcttgtcacgttcaaggttttcagttatacttggcagaataaataaatacatctactccatctttccagaacatcactgctttttgttcattttatttatttattatttactgagacaaggtcttactttgttgcctgggctggagtgcagtggtgctatcatggctgactgaagccttgaactcccaggctcaagcgatcctcctgcctcagcctcccaagtagtttggaccacaggcatgggccaccatgcccagctacttttcattttttgcttttgttgactagccccacagagttttgctgtgttgttcaggttggtctcaaacttctggccttaagcaatcctcttgccttgctctcccaaagcgtattacaggcgtaagtcaccacacccagccctatcggtgcttttggaagaaggtgttcttccctctctctgtttccctccctatggccagctgcccatagagggcagtggtgctggagtgaagacctctcagcgcatccctcttcatctgtaggatgtgcatggcttccaatgctgtctgttctgctcctgagacactcgctggctacaggattataaaggtgatgaggtttcagcctaaagactctccattcaataacacttcctacaagatatcttttttgtttttttgtttttttgagacaggatctggctctgtcacccaggctggagtgccacagcgcgatctgctcactgcaacctcagcctctcgggcttaagtgattctcctgccttagcctcctgagtagctgggaccacaggcgcccgccaccacacccagctaatttttggattttttttttttttttttttagtagagatggggttttaccatgttgcccaagctggtcttgaactcctgagctcaggcaatccacccgccttggccacccaaagcgctaggattacaggcatgagccaccatgcccagtcctacaagatatcttttctttttcttcctttctttctttctttctttttttttttttgagacagagtctcactctgtcacccaggctggactgcagtggtgtgatctcttctcactgcagcctccgcctcctgggctcaagtgattctcctgcctcagccccctgagtagctgggactacaggcgcctgccaaaacacttagctaattttttgtatttttagtagagacggaatttcaccatgttcgccaggctggtctcgaattcctgacctcaagtgatccacccgcctcagcctcccaaagtgttgggattccaggcatgagccaccgcacccggccgagatatctttttcctcctcaatatctatgtgctcctccctcaacccttgggggcttcagtgtaggtggtcagattccccaccatttatgcctatgatgaaaagagtggaaatggtaataactggatggtgtcactaaactacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtrccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcrgagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctkatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgartataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctyggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattgggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacatctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggwtgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacrcctgtaatcccagaactttgggaggccgaggcaggcggatcacaaggtcaggagatcgagaccatcctgactaacacagtgaaaccctgtctctactaaaaatgcaaaaagttagccaggcrtggtggcaggcgcctgtagtcccagctactcaggrggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgwgcaaaagtgattcaaagtggagaaaagcaggactgcgttgggtgcagtggttcccgcctgtaaccccagcactttgggaggctgagatcggaggatcgtttgagcycaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacaraaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtsccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccrgcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacrctgggacttattcctgtgtggcagaaaacattcttggtactggacagaggggcccgggarctgagytggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgctyggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactcyagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttrcgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcggcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgygcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctgrggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttccttccttcctttctctctttcttttcctcctcctcttcttcccctcctcctcctcttcctcctccttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcctaaagccctgggattagagccatgagccactgtgcctctccctgtttcctctcatgctcctctctggccctgtctgctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaagatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccattgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccrgagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgyctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaartattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgwgactctgcctcaaaamaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagncccccactccctgggatgctacaatccaatgatggaagatggcattagctacaccaccctgcgctttccmgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccrctcggcaacaagcctctgrgtaagggccagtctccagaagtggacctgctccttcaagtcagcagcacacatgcscagtccgttcttatcacaaagatcaagasctcrtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggaggrtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcrcacacacacacacacgcasacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccaattcttgcacaacccatagctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccattctccttagagggcaggggtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctcgtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgagcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcaagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacacctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagagaagatctggaaaacccaatggctccccagggcttcgctcttgctgcaggaggggaaaccacactgctgtggattcttcctccattctgtccatttctcagttcccaacaacacactgaacagtaggaggccagttctccgctcacagcgggcgctgcaccccaggtgctgctctcgagaaaaaggcgagcatggaccaatttagtggctccgaggtatgaaaagcagtgagatggtgtctttgagggagttagtgataggctgagacccccttgctgtcccccctgaagcctggtgaccagagctgccaggaggccacacagagagaggtttatgatgggggacctggaattcggaaggggcagagtggtcaggtgacccatacacgcctgagaaaactgatgtggagagctgtgttgtcattctgaggcaggaaatagagacagactgacagacagacagaaagacacgggcacattgagagacagagacagaatcacagagcagagctggcttctcaccagcaggcgtgggcacacctgagagagcatccagagaggttagaaatcttccttaggtcctcctgggaggctcaggtgaccccagtgggaaacatgaaaggctgggaggacttccagggctgagagaaggaagctacgcagccggccggtgccacattccctgtgccttggggagtgtcccccagtgtccccagccatgcaccctggggggagtcggcttggacatctgtgccaccccttgacaggcagagtgggggccacaacctgggccctccagtgctggtcagcagaggctgcccccgccccttgccttcctcctcccgctccttcctccagccctgggaaggtcggaagccaccaccatggggctagtgcggaagcagagggagaacagaggggccctcctcgcaaaaactaaaacaagcccacagcctgtgcagaaccgcacccgggtgtgatcactccttaccccacacacccactgccacttggagatggcttcatggctgcagtcacagggcaccctgtgttgtcaggggtgagccagtgaggcccgggacctgcccaggggtgcatcaagggtggagaagacctggccccagcgcaggtgtgaacaggcaggagggctggggagggaatagcgctgggttgtggccgagcccccaagccctgctcttgagaggcactggctacacactcggcccctacccagacaggaccccaattcctccctggcccctctgtgttcctgcatcttcccagcccctcacctcctctggcgtggcctcacctccagccgggatgccccattagctgctcacccaagctgctagaacctcaggctaatggccctgtcacccgccctcctccccttccggctcactgcccatcccgggcatcctccatcagcccgctgaggggactgctgagcctcagagacatctggcagcaccaggaggtgggtccctctctctgtggctcctctcttcacctgactgttccccagacccccagaccccctgcccaggtggcccctgagaactgctaagctcaaccgtgacatggatggggccyrgctgacccttgggctctccctgggggacccccttttcctgtccctggccacaccctcaccttatccacacccttctcctccctgctgccccgccggctttccaatgtgggtggggggtgggggcagctcctgccttgccagggaaccagggagggcagtgggctcaggagtcaaactcccattcccagggaaggctcaggctgtgggcccagccctgttctgaattctctccacccctcctccccacagagtctcagaaatcgagaagctttcttcctctgggacctgtgcgccacatcctatctcctgtgacgctgcaggagcttccctggttttaagaggtgacatggtggagagaaagcacaggactgggggccacaggycctggcttctcatccaggctccgctgctccctgactgctgcctttctctgtgggcctcgtttcctccctgatcccaccaggtgaattgtaattctccacacagggctggaacccgcgagtgatcccaggagcccctcctctccggggccccaagatctgaggacagggagccaggttgcacacaggagccgtgcaggccaggacggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcgggggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaacccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgc

SEQ ID NO: 17701 - DNA, 33988 bp, Homo sapiens
attattattagagagagtgtccctctgttgtccatgctggagtgcagtgatgcaatcacagctcactgtagcctcaaactcctgggctcaagggatcttcccacttcagcctcctgagtagctgagattataggcatacgccaccacactctgctaattcacttattttttggaaagatggggtcttgctgcatggtccaagccagacttacattcctgggctcaagcgatcctcccacctcaacctcccaaaacattgagattacaggtctgagccaccgcaccctgcccattctacttcctggctcttaaatatgactactctagatacctcatataagtggaatcatacagtatttgtctttgtaactggttcattttacttggcataatgtcctgaaggttcatcctcatcgtagtgtgtgtcagaatgcccttccttttaaaggatgaataatattcccttgtgtggatatatcacatgttgtttatccactcatcattgatggatgcctgtgttgcttccacttttggctgctatggaaaatgctgctatgaatacgggtgtgcaaatattcatttgagtccataattttgattgttttttctttttgagacagagtctcacactgctgtccaggctacagttcagtggcgcaatcttggctcattgcaacctccacttcccgggttgaagtcattctcctgccttagcctcccgagtagctgggattacaggtatccgccatcacacctggccaatttttgtatttttagtagagacagggtttcaccatgttggagactggtctcaaattcctggcctcaaatgatccacccacctcggtctcccaaagtgctgggattacagtgagccaccatgccgagtccataattttgatttttaaatggtggctactaagtttttctggcaccccttaaattttgtcaggcacttgccttaccctagtcctggccccagtttgggttgtcacagcaaggtggaagtgtactgaaaagctcgtgttttatctttatacatttacatggggccccaaaaagggggaaaacccactttgatagggatatgacacagggacgcaggagccaaccgaaagagcccccagtggccaaagatggagcaacttgagcaacaaaataaataaagtaagcatcaaattatagcccaaagtataaaataagtgtctatgagtctatactcacatagatgatttaatacattcatattaataaatgggagagcactttgagaggccaaggtgggcagatcacttgagcccaggagtctgagaccagattaggcactgtgatgaaaccctgtctctaccaaaaacacaaaaattagctgggcatggtgggrcatgcctatagttccagttacttgggaggctggggagggaggattgcttgagcctgggagacggaggttgcagtgagctgtgatctcaccactgcactccagcctgggcaacagagtgaggccctgtctcaaaataaataaatatataaataagataaatatataaataaaaataaaaataaacgggaaagaagagacaaatcttctgtgcaggagaatcccaaatgaattctgtagattctccaccctacaggagggcacacacaactccaggctgccttagtgaccttcttccaaagagtacagtacgggaagggggagcggggagaattaacttcacagtggagaaatctgacaaatacgacctccgccaagtgatcgaggtcacatcagctgtcatgaattatgttgatagtgggcatcctggatatgatgggatgaaatggcactttacctccacgacccttttcacaacagcccgtaatgccagtataaggaaaacatcagaccaggagtggtggctcacgcttgtaatccgagcactttgggaggccaaggtgggtggatcacaggtcaggagtttgagaccagcctggacaacatggtgaaatcctgtctctactaaaaatacacaaactagccaggcacggtggcgggtgcctgtaatcccagctacttgggaggctgaggcagaagaaccgcttgaacccgggaggcggaggttgcagtgagctgagatcgcgccactgcactccagccaggttgacagagtgagactccatctcaaaaaaaaaaaaaaaaaaagaaaagaaaagaaaaagagaaaagaaaaacatcagacagatcccaacagaagggcatcctacagtatacgtgaccactgctcctcaaacctgtcaagactatcagaaacaagagaaactgtcacagctacaaggagatgtgacaattaattgtgatttttttttttgagatgtggtctcgctttgtcacccaggctgcagtacagtggcacaatcacagctcactgcagcctcgaactctggggctcaagtgatcctcccatccatctcagcctcccaagtagctggggctatatgcgtgcaccaccacacccagctaatttttgtatttttttagagacggtatttcgccatgttgcccaggctggtctcgaactcctggattcaagcaatccacctaacttggcctcccaaagtgctgggattacaggcatgagccaccatgccttgccaaatgtgatgtattcttgatgggatcctggaagaggaaaaagatattaggtaaaaactaaggacatctgaataaccatggatttcagtaatgtatccacactgattcattaattgtaacaaatataccgtatgaatgcaagatgttcataatgaggccggggcggtggctcatgcctgtaattccagcactttgggaggctgaggcggaaggatctcttgagctcaggagttcgagaccagcctgggtaacacagtgagatccccatctctacaaaaaattttttgaaattagccaggtgtggtggtggcacatgcctgtagccccagctactcagaagactgagacaggaggattgcttgagccgggaggttgaggctgcagtaagccaggatcacgccactacactgcagtctgagcaacagagcgacaccctgtctcaatgataataataacaataataataataatggaaactcagtatgggttgtatatgggaaacttgctcagtttctctgaaaatctaaaattcttctgaaaatcaaagtctgcttaaaaattcacatggggtttgcattctcctccatgacaaggttttgcaggttatgattacagaggctggagagggtgcaggttatcccgcccctccctgtcccagggattcccttccccaggagctgtgtctcccctgtgagagagggtgagcttccatgaccccaagcctcttgccctctgactccggtattcttagaagctgggaccagcactgagcccaaattcccgaagcgctcaaatactggctttctgtccctatgtgacctggagcttgtagtttaacttctctctgcctcactgtttgacctataaagcagggcaatcaaggcatcccgggggtggctatgaagagtgaatgagatagcagacaacccagatgcctaccgacaggtgaagggaccaacacagtgcggtataggcgtataagggaatggagtatggacacagcctacaacacagacaaaccttgaagacattcctctaagggacataggccaggcatggtggctcacacctgtaatcctagcattctgggaggccgaggcgggcagatcacttgaggtcaggagttgagaccagcctggccaacatggcaaaatcccgcctctactaaaaatacaaacattagctgggtgtggtggtaggtacctgtaatcctggatactcgggagactgaggcaagagagttgctggaacccgggaggtggaggttgcagtgagccgagattgtgccactgcacttcagcctgggcgacagagcgagactctgtcgaaagaaagaaagggaggaaggaaggaagaaagaaagggaagggaagggaagggaggggaggggaggggaggggagggaagggagagagaaagaagaaagagaaagaaaggaagaaagaaaaagaaggaaagaaagaaagaaagaaagaaagaaagaaagaaagaaagaaagaaagaaagaaagaaagaaagaaaagagtgaacccaggaacgaaagatcacacacactgtatgactctatttacatgaaatgttcagagtaggcaaatccatagagacagaaagcacatttatggttgccaggagctgggaaagggcaggatggggaatgactgtttattggatgtggggctctattttggggtgatgagaatgttctggaattaaattcatggctgcataacactgtgaacatactaaatgcccctgaattgtacactttaaaatggttaaagtggcaagttttcactaagcagtaaattaaattctactacaattttaaaaagactaaaaaataatttaaaaaagattaaatgagataacgcaaaaaagcattatctcgaaaatacagctgatattagtataattcttactaagttttaagagtctaaggtgcaggattctaagtttaaagggataggctcttttggttttttggtttagttatttggtttttttttttaatccattatccccacccttgggaggcccccagcacccagtctgcactagaggatggggcccacctcccttttctctccaggcccagccactgaccaccagtaccctggccaggggcaccctcggtcattgccctccgtggcccaaggaagggaacagaaacaacagccaagaagacaatagccgccgggaagtcctcacatttctggagaaatagagcccattaatgaatgaagttcctccagcctgatcggaggacggggtgctggggaggcctgggctaaagggctcacctccagcccccaccctggcagggccgatggtacatgctcactcagtgagggggctccagaggtctgtgggtacgaacccaagggctggtgcccaggggcaatcagcttatgtctctgagccttgggaaacagtgagggtcagcccggctccccacgtgcttctgggcagctttggtattggagcaggtgcaaactcgggactagggcaggaccccctgagaggcgactgagcaaggccatcccgactcatgtttccttggccctgcccggggcacagcatcctgcccacatccctgcagccctggctccttcctaggggctctgaggaggcagcacttggccatctggtcacagttgctgcagggcagttcttggccccagctgtaggtaaagtactgtatgttgtaattttttgaaagataacacgttcacacaactcagaattgaaatgccacagacattccccctgctccgcccctttcccccggatacccagtttctcccggaggcagccaatgatctcagaggctgtatacccacccagagttattttatgcatatcaaggaaagtctacatagaggactgtttctggggtacccagatgcagcgtcaaatgccatggaatactacagtgaggacattatcctttcaagctttcaaatcagagcaagggaaaggtcgatgctagagtttctctagcacccatgaagccctctccctttttctactgagttttactttacaggcaacagcaggcttcaagcttggggtcattgtcgggcaacagtatctggcaagaattcaatgtctttttctcatagtcattgtattttggcctctttctatttatggcaactgagagagaaagcttattcctagatatatgtatttaagtaaaaaataaatgaattcatggaaacatattaagcaattatccagataacataagggatggcaaaaatggtgcagatggtggaggggagacaagtagaagttggggtgctcttgttgaatgtctggctctgaactctagaggaggccgcaggggctgggcaggaaggaggtgaatctctggggccaggaagaccctgctgcccggaagagcctcatgttccgtgggggctgggcrgacatacatatacgggctccaggctgaacggctcgggccacttacacaccactgcctgataaccatgctggctgccacagtcctgaccctggccctgctgggcaatgsccatgcctgctccaaaggcacmtcgcacgaggcaggcatcgtgtgccgcatcaccaagcctgccctcctggtgtgtaagtatcagtgcatctgtctgccctgccaggggtcttttcatggacacccactatrccaggagcctccctggcctgaagccagccctgaagcmggctgccacactagcccagagagaggagtgccctgggagggagatgggctgagyggagctgtcatcaccccctcctgacctcgccttcaaggtcaagttctttggtragaaggtcctagctgcattgcaaacagccaggtatagggatttgtgtttgtctgagacccagaatcactggggttcragttagggttcagatctgagccaggttagggggttgagtcagggggtaaagattaggaggttggtgtatatttggtgttgggggtcactctatggccaaagtcaggggttgccatgagctcaggtgacggaggctccatcactgactgttgtgtgactttggccagctcccctgccctctctgggcctcagtctcttgctcaatataataagggtatagggaggctaaatgatacaatttctaaaatagagtatcgccaagttcaaaagccagaattatagacccccaggactacagacagtgtcacagcatcgtctgggtgaggctagggttagtgtgcggctgggctcagggctgcccmatttgctaggatcgtggggttcccatgtgtcaggatccagaggctagggtatgatcaggatctctagctggggtcagggtcagagctctctgtgtcccctagaattgccatcaaccttaaacccagagggaggcccagtccaacccctcagctttaagacctgctgggagcctcatctcagagaggctgagtcatggccaaggccagttgggggtgggagcagggggcttggtgtgggcctgcagcccctcatccactgccctcccctctagtgaaccacgagactgccaaggtgatccagaccgccttccagcgagccagctacccagatatcacgggcgagaaggccatgatgctccttggccaagtcaagtatgggttgcacaagtgagtcgggcctcgggtgtgaccaggctgggggtagggaggcgggaggaacagcctggggcttgcccccagcccacagggaggaaaggcagcagctgggggactcaggtctctccccttgatttggaaccagagcctgacaccttccctacccccaccctccatcccctggtgccctggggggatttattggagtrtatcaacctctccaacagcccctctaagagtcaggcttcaaagggtcctttcccactgccctgggaagatggaggtcttatttcggggtgaatggggggtagggtagaaaaatctcaaacaaaataagtatttttttaaaaaatgtataaatgttgttttcttatagtacagacaggtcttgctatgttggccaggttggtcttgaactcttggcttakccagtcccccaccccaagcctaaaattagtatcttgactttatttgggatgatggtaacagtcaagggtcggttgtgggccaggtgcttttacaaacaatatcctcacctttatcatatatttttttctttcttgtttttcattttttgagacagagtctccctctgtcacttaggctggagtgcagtggcacaatctcagctcgttgcaacctccgtctctgggttcaaggaattttcgtgcctcagcctccagagtagctggaattacaggcacacgtcaccacatccgcgtaatttttgtatttttagtagagatggggtttcatcatgtgggccagactggtctccaactcctgacctcaagtgatccgcccacctcagtctcccgaagtgctggggttacaggcgtgagccaccacgcctggccctttatctatcttaatctttattttatttatttatttatttatttatttatttatttatttatttatttatttattgagatggagtctctcactgtcacccaggctggagtgcagtggcacgatctcagctcactgcaacctccacctcccgggttcaagacgttctcctgcctcagcctccctagtagctgggattacaggtgcccaccaccacgcccggctaatttttgtattcttagtagagacggggtttcaccatgttgacctggttggtcttaaactcctgacctcaagtgatccacccgcctcggcctcccaaagtcctgggattgcaggcgtgagccacagcgtccggcctatcttaatctttatcatatattttagcctcttctgtaaaagaggataatgccatcgcccggatgaccctgcttaacaaacacggaaacaggagccgatagaggtttagcagcctggcggagctcatgtgcaaactcagctcagtatcggaaactcagccaccttcatggcacctcaggctgccctggagcctgggtcccggtctgtgtgtcggtctgaggccccaagggtggggcagacattgttcagggaccttgtctttgtcttaaagccaatctcctcctcctccccggccctgctaaacacgctccccaggggtggtctctgctacccscgcacattgggccttgagtcttggtaaatgtttctgagccaccagggggcgccagcggtgctggatgccacttcgccttttgcaggaaaactcccgccgctagcgggtgctgtggggcgtcccaggtctcgcgcagccacgccctctgtgtgaccttgggcttcagtttaggcttctgtaaaagagaataatgggcaaggtccagtggctcatgcctgtgatcccagcactttgggaggccgaggtaggaggattacctcagccagggttcaagaccacctgtctctataaaaaatttaaaaattagctgggcatggtggtgcgtgcctgcagtcccagctactcaggaggccaggggaggtcaaggctgcggtgagctatgattgcatcactgcattccagcctgggtgacagagcaagactctgttgctaaaaaataaaagaggataatgctatcctagacctatgtgttgcaagaggtcagacatggcaaaagcgttgagaagttaaagaaatagtatccttaataaatcagcaataattcagtaagaccagactgccatagactagatgtcatagtcattaatatataactgttatcccaaacgtatatgagtggggtagaaataaaatatgattggccataactatgattggtcatgattaatgttagatgaagttggatcatgggtaagatgagaattcttcacactattctctctaaagcgaatggaataaaatagaacagaacagaccgggaaagccagatatatgtggattctccttgcctgggcacagtgtgtcatagtggcttataatatgggatttggagtgggatggacccaggatcaaattcccttctactgaggttttctgaagccacataagctgtctgagccatttctgtctcagttcagtgggtacagcaatagtgactacctcgtgggtagctgtgaggattaaaccaggaaatgtgtataaactctaagcacagtgcctgccacacagcatgtgtttggtacgtgatggccgcttctattgtgtcatattccatgtgctcaagccgggccctgggggagagttcagcaagggtagagggatatgagagtgaatgtggcccactggcctccctgcctgcagtctctcctctctgatccttgcttcctaagggtcttcactgagccccacctctgaccaagtccccggcggcacaggcagcacagatcctctgctgtacytacaccaagaccccagggccaacgcttctcccattgtgcagctccacctctgcccccggggcctagctgaggcctcctccaagctgagccacctactatcttccaaactcccaccctccatctggtgtcacctcctcccrgaagccctctgtatcagtttcctgttttctgccataaaaaaaatcactccaagtttagtggcttaacatgacacaagtttaccattttacagtttaaaaggctagaagtccaccatggccctccytgagctaagatcaagctgtcagcagaaccagattccttctgggggctataggggagaattaattccctcgytttctgcagcttctagaggcttcccccattccttggcttccctccatctacttttatttagggcgagggaagcttcctgctctgactttctcatttatggtattctcccctgctttccagcagctgtgattgtcccaartcctgtcctctggttctctaggccagaaaaactatgatctaccagagctcaagaacttgaaagggccttttcccactgtcccttctcacagtgagagccggagcccagcttcgtgctagaatctgtgaaaatggagaaatgcaccctgtgctgttctcttcctccacccggcatctcccctgcagcccggctgggtttttttgtttgtttgtttgtgggtttttttgtttttttgtttgtttttgagacagagttttgcacttgtcgcccaggctggagtgcaatggcacgatctcgactcactgcaacttctgcctcctgggttcaagcgattctcctgcctcaacctcccgagcagctggaaccacaagcatatgccaccactcccggctaatctttttttttttttttatgcatttttagtagagatggggtttcaccatgctggccaggctggtctcgaactcctgacctcagatgatccacctgcctcggccttccaaagtgctgggattataggcgtgagccacggcctgggcccagtctgactgttttcacttactctctaatgtctcaggtagtgtttattgtattctgtgcagaggtcaagaatttagtcatccaaggaggttagtgtattaggagcttacgcagctattaccagaagagactccactcaaaaatttggtacgtggctgggcgcagtggctcaaacctataatcccagcactttgggaggccgaggcgggcagatcacctgaggtcaggagttcaagaccagcctggccaacatggtgaaagcctatctctattaaaagtacaaaattagctgggcatgatggtgcatgcccataatctcagctacttgggaggccaaggcaggagaatcactgaacccaggaggtggagactgcagtgagctgagattgcccgctgcactccagcctgggcagcaagagcaaaattctgtcacacacacaaacaaacaaacaaacaaaaaaaacgggttgggcatggtggctcatgcctgtaaccccaacactttgggaggctgaggtgggggaatcacctgaggtcaggagttcaagaccagcctggcaacatggtgaaaccccctctctactaaaagtacaaaaattagctggatgtcgtggcgggagcctgtaatttcagctactagggaggctgaggcaggagaatcacttgaacccaggaggcagaggttgcagtgagccgagatcgtgccactgcactccagcctgagcaacagagccagactcagtctcaaaaaaaaaaaaaaaaacaatggtatgagctttaaatttctgtagaactgaaagaggattggagattgtagtagggtctaattctaaattagagcatttagaataatgtggagtctggtcaacatagtgagacccccccaatctgcacaaaaaagacaaaaattagccaggcagtgttggtgcatgcctgtggtcccagctattccagaggctgaggcaggaagatcgttggaattcgaggctgcagtgaactgtgattacacaactgcactctggcctgggcaacagagagccaccctatctcaaacaagaaagaacaaactaaaaaaaaaaaagaagaagaagaatttggagcaatctagttgtttcctataccagaagtctttgccaatctatttttttttaattttatttttaatttttgtgagtacatagtaggagtatatatttatggggtacatgagagtacatagtaggagtatatatttatggggtacatgagatgttttgatatagacctgcaacgttttgtcaatctattttttttttggcgacagtcttgctctgttgcccaggctggagtgtaatggcgcgatctcagctcactgcaacttccgcctcgtgggttcaggctattctcctgccttagcctccaaactagctgggactacagacgcccaccatcatgcccggttaatttttttgtatttttgtggagacgagatttcaccatgttggccaggctggtcatgaactcctgacctcaggtgatctgccctcctcggcctcccaaagtgctaggattacaggtgtgagccaccacgctggcccaccaacctatttttgatctaactttacctctggtggtgtattgatactcttccgaatcaattttcacccttcttcatataccatttacatttctaagaatttgtccatttcatttcatctagttaacctcatttgttgacatacaattgttcgtagtattctctcataattccttttatttctgtaagactggtaataatggccttgcttttatttctgtttttagtaatttgagtcttcttctttttttttttttttgccagtctagctaaaggtttgttgattttgttgatcttttggaaaaaccagctattgttttcaccgattgttgtttttgttctattatttcattcataggcactaagatcctgattacttccttccttctgctagctttgggcttagtttgcccttatttttcaagttccataaggtggaaagtttgattattgagttgagatctttctcttttttaaagataggcatttctagatataaatctccctgtgagcacggttccctccatcttcagcacaccagggttgactctctccgggcgttcttccctggtcacctctccccttcctctcctcttctgcctcctcttccacttttcggtaccctgtgattgtattgggaccacccagataacctaggatcatctccccacctaccccaaggtccttaacttaaccatactttcatatgggtaacacgagttgagtgtggtacccagggtttgacatgytgggtaacatatttgcaggttctgtggattaggaggacattttgggggccatgattctatcttccaccctcgcctagacaaaattggaggctcactccttgggctccctggatgacccccaacatccttcctcacttccattccttcccagcatccagatcagccacttgtccatcgccagcagccaggtggagctggtggaagccaagtccattgatgtctccattcagaacgtgtctgtggtcttcaaggggaccctgaagtatggctacaccactgcctggtggtaagcattcctgtcagctgatgccccatgccctggccctctctgggctggagggctgaatgagggtcctgggtccttggctctttccaggctgggtattgatcagtccattgacttcgagatcgactctgccattgacctccagatcaacacacagctgagtatgtgtcaagcgtcctctggggaagtgggagctggactccagggcttggcctcagcagagggggaggttgtgcaggcagagggttctggggccaccaaaggaggcccagcctgggaagtttgcagggktggggaccccagagctggccaagctcttgactggcctgggcagcatgtggataccatctgatagcggaggctgccctgaggtcatgtcgggtctccctgcagcctgtgactctggtagagtgyggaccgatgcccctgactgctacctgtctttccataagctgctcctgcatctccaaggggagcgagagtaagtacaccaccctgtggcccccattcctgctcgtgcccatcctgttagtgtgtccacggcyccytccaggctcaaccccacacagggcatgcttgtgggtggccaaacctgagggcagcaataccttcagtggggtcacttcctaccccctcccatcaatacaccctcaaaggctggaaacaacaataaccaacagctagtaactaacagctattaagaacttgctgtgtgcaaagcactattccaagcccttttcatgaattaattgattttgtccttaaaaccaaccctaggatatagattctgttatcatcccctttttacatatgggtaaactgagtcacagagaggttagaaaggaaaagctcatatctacggagtssatcctgcattccaagcaccacactaactcagagataaaactctagccaagctaagtaacttgctgaggacacacaactcgccactaagggatgggagtaggatttgaacccagmmttctctgaccccagaagctgagttcctagatactttactctcctgcttcccagggtggggctttttgtcttggccaacaccctctgtcaaggagctgtgggtaaccccattgcacagaggaagataacaaggtttggagagtccctagtcatgttaccaatgccaaacctggaaggcagaagggaactggtgggtggggtctggagaggagccctctattcaggccattttctgactctggagcagacggatacatgtatgaatttggactctagacacgttctcgtgtgtgtgacaggtgtgagcgtcacaggagctgggccctcccgaggrattctgggatggtgccacagttaattcttgggtctgaggctccgtgttctcagctgcaaaatgggagtgataattcttacttcctgagctacaagagtcagggccaacagagccatgaacggtgcctggtacacactaggcrctycatggatgcacaggactggtcaggggctcattgtggtgcttgctgccttcaggcctggrtggatcaagcagctgttcacaaatttcatctccttcaccctgaagctggtcctgaagkgacaggtgagtgaggctggctgactccctgtggtccagggccatgcccaggaggctggatccctttcctccctgcctttccctgagaaggtgccactcccaccttctccatgtggccagtcccctgtgccggtccccagcactgccaccaccacgcagctggaaggaggcactgcctctggcctcctttcctgcctggaaagcacctgctctgtctgccccagatctgcaaagagatcaacgtcatctctaacatcatggcygattttgtccagacaagggctggtgagtgygtttctgtctgcatgcctcagaagacagcagtgggagccagaaagccacctgctgcactatgtggccttgggactgtcactcttcctgtctaggtcccatgggctctatctggctctgacacttgatgattagttatgagcatactttggcaaatctctgcccctttgggctgcagcmtcacaagctgtgtggcgttgggcaagtctatagaactcaggacaaatgggtgattaagtccaagaggactycaagattctcctggaagtagattaggaaaaaagataattagattgctcacatggctgggcactcatccaygtactgtactctcctatgcagtacagagcagagctgggtttcagcccaagtcttggactctgctctgaaccaaccttctagaagggctctacctacccagacagacagacttgggaaaagagagaatgaaaaagtgccacacccctccccgcacacccaggtcccactttacagaggggaacactgaggctggagggttgggtagctgtgtggatgcaggggagcggtgactcagggcaattcccccatcctgaggccctgygttgatcttttcctcctgcagccagcatcctttcagatggagacattggggtggacatttccctgacaggtgatcccgtcatcacagcctcctacctggagtcccatcacaaggtaggagttgtgggagggtggggcagggcccagcttccccaggggagttggtccttttttgtgctctgacaaccccgtcccccagcttcaaccttatggcagccaagagtcctggggcgctcctcctcattcctgatgctcctccgcattcctgatgctgcgaggagggcaggccacagcgacgtgcccctgacccctctctgcaggcaccagggctgcccactacaaggatcccagcaaagcaccagctccttcctagagggcttattcggcttctgtcatcctctacagcagtggattgtggccccycccagggggtactgacaaaagctttggaccctctattacttaggatatagatttctgtaacaaagaaatccgaaataatagctgcttaaacacaataaacagttatttccctctgttgcgttctgagcatctgcagccccgcgggatcaggaggctgcagggtgtcaggcacgcaggccccttccacgtgttctcagccagccccaggcatgacctcatcccagggtcctggctgactggcctgaccaccacacccactctgctcacagcccgttggcctgaacctgatcgcaggaccccaccctagctgcaagggaaactgaggaatttatttcagctaaatattgagaccagctaaaagttaagtggtacagaatggagggagagattggagaagactttagggcggacccagccatctttgtaacagagcctctccctggaaaactggacagaaggatcatttcagaggttcatggccactcctgaagcctgttcacaacccatgggctggatgatctagwggggcgggggactgggcagcagcttgttttcctgattttggcctccaggagccgatggtcaatggactgccctctgcaggggcagggctggtggtcagctggggcggggtgggagctggaggtccgtggtcaccagctgccctgactaatgtcgttacttgaatataaccctgtgaaggcaggaaccacgtctgtctggttcacttcccacggtggttgagacatagtgggcactccggaagtatttgttgaatgagtgaaagccccgctgggggaaactgggtacagctctttcctcagtttccccatctgcactctgggctgaatgctggggctcctcccaatctccctgaagctggaccygagcccagtagggacacacagggtccagccagcgtcctggcttcctccagggtcayttcatctacaagaatgtctcagaggacctccccctccccaccttctcgcccacactgctgggggactcccgcatgctgtacttctggttctctgagygagtcttycactcgctggccaaggtagctttccaggatggccgcctcatgctcagcctgatgggagaygagttcaaggtgagtgggtggggctgggctgckagggratccagatggcatgtggtatgtgtgtgtgygcacacgcatggggaggagggaggaaactcggaaacttggtggtgggcaaaagaactaagctggagcaatagcagtgaagtccagactgggcacagtggctcacacctgtaatcccaatcctttgggargctgagatgtagcaggacgaaccgcagacaaaactcctcagrcactgagttaaagaaggaaagagtttattcagccgggagcatgggtaagactcctgtctcaagagcggagctctccgagtgmgcaattcctgtcccttttaagggctcacaactctaagggggtctgcatgagagggtcgtgatctattgagcaagtagcaggtacgtgactgggggctgcatgcaccggtaatcagaacgaaacagaacaggacagggatttttacaatgctctttcatgcaatgtctggaatctatagataacataactggttaggtcaggggtccatctttaactaccaggcttaggtcaggtaggcccaggcctggtttcgggtctggttccttggtttcgggtctggtctctaggcgttgggctacctgcctttagtttcrcttctctttctttttctgagtataaaacaatataaaacaatatgagagggtctgtctctcttctctcagagacaggagggtccctggaggccaggagttcaagaccagcctgggcaacatggggagacccctgtctctacaaaaataaaaataagtttaaaaatcagctgtgcacggcrgtgcatacctatagtcccaactactcaggtggctgaggagggaggatcacttgagcccargaggttgaggctgcagtgagctatgatggcaccactgcactccagtgtgggtgacagagtaggactccatctcaagaaaaaaatacagtccagcatttattggagtcaactatgtgttgccagatagatagatggatagatagacagagtgatcaatagatttaggtatagatataacttggcacgtagtaactgtgcattaaatataagttgatattagwcttacatttattgcagttatatttgctacactttgttttgttgcactcatcctgtgaaataagtactgttacctctgttttgcaaacaaaaaaaccacaaagctcagagaaggtaggtgacttactgaagatcacacagcctgtaagaggtggccccaaagcctgtactcttcacctatactgtactagaaatgcttaggtagtttccaggctgtgcttgtcattgaactcatgaggaaactgaggcccacagaggggaagagacttgtgcgaggtcacacagcatgtgtggggcacagtggggagcagaagccaggcctccagccgggacaggggttccctgttccacaccctgcccagagcatctcacatgttgtctgggaggttgggagttgcgtctgaggaggggtccagtccttgaaactgcccttggtccctgcgaagttttcttctgaggagtggactttactccacccaccctccaacttcctcatttcttttcaggcagtgctggagacctggggcttcaacaccaaccaggaaatcttcyaagaggtaactgccccctgcccctgtgtggggtttatctcacgtaccccaatcctgctctggcttcaagagcccccacacagccaataacaccaccaatggcaacaattataacagcgaacacagctcctactcggktgttcggcatggagtgaagcacttagtgtgtgtgacttccttcagtgctcacaccgaccctatgagtggggcggtcaaactgtccccattttacacacagggaaacttagtgaatggcaaggctgggtttgagcccagctctattgcccccaaagataaggctccattccctgctccattwcccaggcatagrgacttgtagggggctggaaccccaggatcaactctgggctcagagggccccagcaataagtgactgttgattactcctgatcccaaagctgacttcaggcaagctccttggaggtcgcagccccttcttgctatgcccagtggcaatgatgttcataatcccactcctcagtgcagggttccactaagaacccatgatctcctacctcaaatggacctcatgctttctgagtaagcctccctcagctttctggtcacctcactcccccacccactgcaatgacttcttcaggccttccctgccatcctcaaatctccagctgccccctcctgtctaccttccacttccctctccacacacaacctgcttaccagagagcwgagcagagccaccaacagaacttcccccccacgtcgctgctcccagtcgcaacccactcacccacacctgcgccttcctgcggccgttctcctgttctaacagaggacrgtccctcttcccttctgaactcaggccgtccagccttccccggctctgtgatgyctctctccytgcacatacacaactcacaatattgggcaggcccctgaccggcycttctcccttagccccttgtctgagtcctgttcctttgatgtcctatttctagtctttccatttctctctgtctctacctcctccccaggctaccattatctctagtggggacccatctgtagctcccggtgggtctccctgtgtcctgataccctccaataatctgttccccacagcagccagaacaatcttttcaagaaataaaactggtcattcacctgcctgcttaaagccggtgtaggatacaggctaaacgctctcccatggcctccagggccctgcattttctcatcctgtctacttcttcatctagttgtttcccacccagcgtaattgtaactgtttagttgaaagttgacgaggtcttttgtcagctctagaaatttcttttcttttctttcttttttttttttttaagacagagtcttgctctgtggcccaggctggagtgcagtagcacaatctcaactcactgcaacctccaccttccgggttcaagcaattctcctgcctcagtgctgaaattacaggtgtgagccacagcacccagcccatcagctctggaaatttcttcatcactctctcttccatgattgccccatccctattttctccatgcctacctcctggaatttccatgagacacacgttgggccatctcattccattttccgtgtctcttagttgctctgtcgtgttttccatctcttttatctctatcctaaattctggatagtttcttcaagtatctttttagttcattaattctttttacagctgtgtcttatttgtttacttacccactgagattttcattttattttatttaattaattaatttrtttatttttgagacagagtctcgctcttgttccccaggctggagtgcagtggcgcaatctcagctcactgcaacctacgcctcctgtgttcaagcaattctcgtgcctcagcctcccgaktggctggggttacaggggtgcaccactgtgcccagctcattttttkgtatttttagtagagacggggtttcaccatgttggccaggctggtcttgacctcctgacctcaaatgatcctcctgcctcagcctcccaaagtgccgggattacaggtgtgagctcccgcaccccgccggccctttctttcttttgagctgagctatgtatttaatgaaaccttttcttgtgtatccagcrgttcagtggtttcttggggcatgtgatctccttgagcccagtcccacaggctgtaatcgaaggtcctcaggccacactccccagccccgctggctgcctgcgcattccttatcttggccatgttccttccacagggctcttgtccacactgtcccctctgccagaatggtttgccctcccccatgccatctgctcctcctcctgccacctcagggaaggcctctcccacctccctgactaggtcaggtcccctcgtgccacagcctrgtgtgtctctcctttaaatactcctcagctgcagttttacgttctgttctgggatgccctggaaaatgctgggctcctgcagatatggcccgcagctcctgcgctctctgctctatccccacccctagcccagctgctacagcagcttccctcggagggttaccatgcagtaggtcctgttctaagctctttccacagattatctcattccatcctcaggacaaccctatgaggtaggatctatgattatccccattttacagatgaggaaagtgaggcccagaaggctaagtgaaggcatcctcagcacatcctgagagaggagttcagggtaggaatagcttcactagcacacagatgagaaactgaggcccagagaggacaagagtcctaatttgcacagcctggggcctgggcactaccccgagctacttccttttccccagccctggggcccggagccagctttgtccttcccatctcygagggcatggactgctgctgccctgatgggcccctgtcctggccatgggacccctgtcttccacaggttgtcggcrgcttccccagccaggcccaagtcaccgtccactgcctcaagatgcccaagatctcctgccaaaacaagggagtcgtggtcaattcttcagtgatggtgaaattcctctttccacgcccagaccagcaacattctgtagcttacacatttgaagaggtgaggcgggtgcagggagaggtggtggtgggggaacctgactcacatatgggccgcagagggcaggggcctgggggtctctgaagcctccagatccttctcaccacctctgctggcactggttgtctcttgcacatggctccttacaatcaaaatcacatcatgcaagtaacgagggggtacacacgtggtttccacagcttaggtaatattttctctcttttcttatttttattttttttagagacagggtctcactctgtcatccaggctggagtgcagcctcacactcatagctcactgcagcctcgaatcctgggctcgagtgatcctcccacctcagccctcctgagtagctgggaccacagacaaacaccaccacacctggctaatttwaaaaaaaaaatttccttagaggcggggtcttgttatgttgtccaggctgttctcaaactcctggcctcaagcaattctcctgccttggcctcctaagttgctggggttataggcatgagccaccatgccaagcatrtgttctttcattcttatttttatttattatttatttatttacttatttatttttttgacacagagtctcactgtgttgcccaggctggagtgcggtggcacaatctcggctcactacaacctctgcctcccaggttccagcgattctcatgcctcagcctcccaggtagctgggattacaggcatgcrctaccacgcctgactaattttttgtatttttagtagagacagggtttcgctatgtgggcccagctggtctgagactcctggtttcaagtgatctgcccgcctcagcctcccaaagtgctgggattacaggcatgagccaccacgcccagccaatattctcctccttaagctgagcagtggacaatggtgtttattacccgagtccacaaccctttattcattagggccacaagggtttccaaattcagaacttctgtgaatttgtaaaagtagtatagtgtatagacactggatatattgcagaacaccccaatagggtgtggggtggcaccccacaatcaattctcctcaaatgcctcaattggcatttctcctcatatgaagcaagataaataccatacatagcttcctagacaatggccaggttttgccaacaaaacttaagaaaaaacttgtagttttcagatcctgtttgattttataattacaaataaggaattaagaatcagtattatctttaatgctccttagaatatcttcaatttttttttttttgagacagagtctcactctgtcacccaggctggagtgcagtggtgcaatctcggctcactgcaacctccaccttcctggttcaagcgattcgcgtgcctcagcctccccagtagctagctggcactacaggcgcgtgccaccacgcccagctaatttttagtagaggcggggtttcaccaggttggccaggccagtttcaaagtcctgacctccagtgatccacctgcctcagcctccaaaagtgctgggattacaggcatgagccactgtgctcggccaatatttcttaatacattaagaactaaagacaagagcgatacaatcacattgtggaaaatatagaaaaatagaaagaagaaaaccactgtcaccataacccccttctccaggggccttcgatgtggtgactgggtgcatttccttctggtgctttgttatttttaaataaattttttatcttggagtaactttatatttgaataaaagttgcaaaatacagagtgttcccatatatcccccacccacttcccgctttgtccacatcttacataaccatgctacagtgtcatagcggagagattaacattggtgcatgactgttaaccaaactctaaactttatttgaatctccccagtttttccactgatgataccctttttcttttccaagatctgatccaggatagcacattgtatttagccgttcttttttgttgttgtttgtttgtttgtttgtctgtttgtttctgcccaggctggagtgcagcggtgatcctcccacctcagcttctcgactagagatgtgcactaccacgtatttttttgtagagacagggttttgccacattgcccaagctggtctcaaatccctgggctcaggtgatcctcccaccttggcctcccaaagtgttgggattataggcatgagccactgtgcccagtttatttagccttttaaatatctctttaatttttgtattactttccttttcatttttctgttttattccttttggctttctcatgtggatgtagacatattattttatttacttatttttttgttgttaagaatctgaaacattgagcatttgttaaaaaaaagaattattcggccgggcacggtggctcacgcctgtaatcccagcactttgagaggctgaggtgggcggatcacatggtcaggagttcaagaccagcctggccaatatgatgaaaccccatctctactaaaaatacaaaaattagccggacatggtggcacatgcctgtagtcctagctacttgggaggctgaggtaggacaatcgcttgaacctgggacgtggaggttgcagtgagctgagatcgtgccactgccctccagcctgggcaacagagtgagactgtctcaaaaacaaaaaaagaaaagaaaagaaaaagaaagtgacttctcrggtcctaaccccaaagccacaggtgctggggaactttcctcggttttcagaagagcagtagctaagcctggttcccgtgtcatccttgcctctccagtccctcagtggaaagaatcaggggccctgagctaggagggttgctctctgcttcgggaagagccctggctcacagcaaatttggtttctctccccaggatatcgtgactaccgtccagscctcctattctaagaaaaagctcttcttaagcctcttggatttccagtatgtgctgcagagaagagagggggcggtcaactccgcaaacctctccctggccccttggagtcaggcacagggcggggtgttggtggggaaatgtggcccctttcttctggggcatatgggctgactgcagggagataagaccctgcctagatagaatcttcgtggggaagaaggggctccaggaagaatggagggagggcctggcaggaggagagcgctgcccragcraaggcctggccgccagaatagcaaatctcaagggaatagcaaatctcaagagagtgccccaaagggsctgagctatgagacaraagcactggctgctattcttagagtttctttcccaggggatgttacaggagggggcccaatggagggtcaaattatcatcgyttttttatttcaggattacaccaaagactgtttccaacttgactgaggtaggtagtcttggatagactgggggaaataagtcctgtgggacctcctgccttaaagaaagcaggcggagggccctaaaggaaatcaggcaaccagaccaaaagaatgtggaccaggtggtccatgctgtgtctcttgtgacccttcttctccctgccatgtcttttgggagagcccttgtgttgcaaaaatgagagtgtggtggtatggattggggtttaggcagaacagtactggccaagcagcgcctccctggacctcaattttccctctgtggaatgggctagcaatcctgggcctccccagggcgaaggaaagaccactcaggaagggcaccgtctggggcaggaaaacggagtgggttggatgtatttttttcacggatgggcatgaggatgaatgcttgtccaggccgtgcagcatctgccttgtgggtcacttctgtgctccagggaggactcaccatgggcatttgattggcagagcagctccgagtccrtccagagcttcctgcagtcaatgatcaccgctgtrggcatccctgaggtcatgtctcgtaagtgtgggctggaggggaaactgggtgccgaggctgacagagcttcccatttcaccttgtgggcccttcccaggcagagcttcaggtgcccctcttcccagtcattgatacttagcggtcctggccccctttcctctccctgctggtggtattgcacgccaatgactcggccagatgcccagacccctgttcttggtttacctgcagaatattatctttgccaccccgcgggatggctcaacccactttcaggatgcaggtctcctaatagcaacctgwtatagcagaaagasccctgggctgggagtctgagacctagttctagcccagccmtgaacctcagtttccctttctgtgaaacaagaaygttgaacttgatgattcccaattttccttttgaccttgaaatggtagaatatttatccctttgaggtgactcggatggtagactctcagacaccatagcacacgtgtgctgggggtattttggaccagrctctgctgagagctttctgctcccttccccacagagtatgttgagctgactgtgctttccttttgaacatctgcttgtccacatggcttaggtaggagaggaagggcgtggaaactggaatgatcctagtggggtgtcttggcatctcttggcctcattttccccatctgaaccatgaagctaaaactaggggatgtggattaaatggttcctacaactacttgcaaggagaccactctgtgtggttgcaaagaacactttgagaagctgtgtgggaaagtttccttcctagcagggtagaytcagctaactgcaggtcatgtggccattgtggatgggttgggagctcaagtttggggcagaagggaattttttttggcagcagagtggcaagccctgccgccaggcaaactctgctcttcctcatcctcagaagcacttgctcactctgctaaatcaaagtgaaacgcatgtttacagaatattggtccaaaagggtctcagcatctcccactacycagggtggcagagcctcgggccggccttgctccccaagaagggctgactggggctctgtcccctgccccagggctcgaggtagtgtttacagccctcatgaacagcaaaggcrtgagcctcttcgrcatcatcaaccctgagattatcactcragatgtgagtacaaagcccccctcaccagcccctgttcctggggagagaggcccagacaggattcctggggtgactgggggctgttggggagacagacagaggggcctctaccagcttggctccctcctggtggcctgggagtcagcccagctcrcccctctctcctactgcccctcccttcagggcttcctgctgctgcagatggactttggcttccctgagcacctgctgrtggatttcctccagagcttgagctagaagtctccaaggaggtcgggatggggcttgtagcagaaggcaagcaccaggctcacagctggaaccctggtgtctcctccagcrtggtggaagttgggttaggagtacggagatggagattggctcccaactcctccctatcctaaaggcccactggcattaaagtgctgtatccaagagctggggagtccttcttctgtggctggcgggtagagggrgggggaagggattgtctcaccagtgccgtccacctcttttcagcccttccaaggcagctgcccccaaaccctccaagcttcatgatgactggaggaagaaatccaaacttctctccttgggactcacgatcctccctgatcaggtccctggataccttccaaatttatcccctttaacccagcactctccttgtctgaccagcttcctgcaggagctgtcacacactctctgtcccttggggttccagtgctggacagaaagtgagggaggaccagggcttcagatcctgaggatggtgggaggggaaggggccctcagaggtctggtttctggtagaaatggaggaagacagagcctttaaaaaggcaaacgactttattccagaagataaactgctcacgagcctgagcttatttccagctcacctttttttttttttttttttttgagacggagtctctctgtgacccaggctggcatgcagtggcacaatcccagctcactgcaacctccacttcccaggttcaagcaattctcctgcctcagcctctcaagtatttaggattacaggcacccgccaccacacctagctagtttttgtatttttagtagagacggggtttcaccatgttggccaggctggtctcgaactcctgacctgcagtgatccacctgcctcaaccccccaaagtgctcatgttaaatatggtgaaccccaagtttttcttcaaagaatcagtatgtctgtatgttcagctctcttattctttgattctccattttaaagtttaacttcctggttctcttcgcccccttgcttctaatttcagtaaacaaccttttccatcagttttattcagtagttcacacctgttcccctggtcacttgctccatcctgactcatcccagtcacctgctttgacctgagtcacccctggtcacctgctctgatgtaagtcacctttagttacccgttcctaactgtccttcctgccaaactactcacctcgccactctggctcatacctctgctctctttaaaatagccaatcggaattagcttagaccgtgcggtccaaccttagccaacaggggaacaacatagcagcagggattacctgggtcaggaataagaaccccttcccctcccttgttcaactgtgctctcaccattgttccatctatgaggagcaccctttctacagaaactaaaaattgcttgctgagaaaattaaatttatgtttgagtgctatttctttgcagcagtggagaacaagcattcctaacactgggattgcaggcataagccaccgtgcccagcttccagctcaccttcttatgctcaaattgtgtcttctccttcccaccctcaagctacaatacaaaaagtttcttccaaccctctcagtcttggaaggtagcaggctctattttctctgggtgtgtaaagaaaatgcctctcccacattagccaattgagacgggaggaagcgcagcaagatgctggctagtgcaaggtccctggggtagaaagaatcatgatggattcaagaacagtcaagagggctggtgtggccctgaaagcaaagaactaggggcgagagatgaggcccaaccagcaggcagggtcacataacaaaggtgataaaagggcttggcctttatttcagcagccaggagagacagccaggaggctggggctgtggggagctcagaagtaagatgccccttcaagtctgggaatatgtgaggggagggcaccatcttctgagccaggtttcttcccagcccttccctgcccttccaagtgctttctgaggcctgtttctcttcctcccctggggcctaatgcaagtgtctgactcactaagcaggagcatcatgggcgggatgggcggctcttaaagggccctggcagaaggagtcagtgtgatctcgccagtccctgagtccaacgtgggaattctgggtcttgggatattggcctttgaggtggtgacaccagttaggagccacatcccacccaagaatgtccccttgaagaggctgggaaggcccaaggcccccaccttgatgctacaatgacagaatcaggataacttggcagccctaaggcagctcttccttgaatggaaacttttatctgcatgaggggcagacagagaagtcacttggagtcttaacccttgtagaccccagcctgactgggactccagaaggtcccagggctctgctccagaaagaagggtaggggcatgcccccagcttccttcagtgaccttggagaggtctccccagggctgagctgggaggcacttccatgtcactgtctcatccaaggagtgcgattagcaggagatatggagtccagagggtgagaggcttaccaaaatgggactgacctccgagcccctctcccaaattccagcccctccatccaagcctagaagctctgacctagtcctattgaagtcctcctggcctgggtgtgtgttggggggaatcctggctccaacccagttaggatcatttccataaagaaggccacacctgctgcttcctctggggaaaaacaagtgctccccaaggccagcaccaggcagaagcacatcctgccacctgggctgctgaccttgggcaggatggggcccgggtgtttggcaaataggaagggtagagggaaggcctggctttcagacctgggtctaatcccagctccccccaaccccagttactaattctgccatcctggggcccctctgtgcctccatttcctcttctattcaatgggatgataatactttccatgtaggattctggcaagggctgggttagcccagaggaggagcccatggtggccaagagcaggggctgcagagctggcctgcctgggtccacccttctgctcctctgcttctgtgtgatcttggccaaattatttagcctctctgtgcctcccttttctcatctgtaaaaagaaagataacagttgccatgaagagtaaaggagaggccgggcatggtggctcagacctgtaattccagcactttgggaggctgaggcaggggtatctcaggagttcaagaccagcctggccaacatggtgaccccccccatctctactaaaaatacaaaaaaattagctgaatatggtggtgtacacctgtagtcccagctactctggaggctgtggcaggagaactgcttgaacctgggaagtggaggttgcagtgagctgatattgtgccactgcactgcagcctgggcgacagagtgagactgtcttaaaaacaaacaaacaaaaagattaaaggagagagcggctgcattttgggaggccaaggcgggctgattgcctgagctcaggagttggagaccagcctgggcaacatggtgaaacccggtctctactaaaatatgtttttaaaaaaaattagctgggcatgcacctgtagtcccagctactcgggaggctgaggcaggagaattgcttgaaccggagaggtggaggttgcagtgagctgagatcatgccaatgcactccagcgtgggtgacagagcaagactccatctcaaaaaaaaggagagagcacagtgtctggtatatcctaagtgctccacgagtgccagacattggttatacttcatggaggtgaggtacacagaggtgtctaggtcatgcggactcactccatcctccagttaaccatgactccctccccacccacctcctgagttctctctgctgtcaaactttcctctcatatctccagtttcccacccaaaagtccaaacactcaagattccttctcatctccaacccataaaatctgatcggcttctccacactcaagtgtaaatgactgatggccatttgattgacactggaggggctggcacatttttagcacatttttagccaaaggtatgatgtgctgatagcggactctcaggccacaagccagtctgaggacagggaaagtttgaggaggtcactcttccagaaccctttggtgataacctttctggcaggcctggtacccccagagtgaaaagggctccagggtcaagacccagctctgcccctcattgctgtgtgaccttcagcaactcacttgatttatctggacctcagcttcttcatctgtctaatgggataataatctttgtcctgccctcctcacagggctgttcagaattaaatgcatctgaaaatgatctgcatttgtgtcttggactgtggttatttgttcaagtgtctgtctaccctgcctgcacagggagcgggtcagggtcttccctgggacttcatgcacaggtctttcctgggacttcatgtaggaccagccatcccgtcagtgctcagtgaacatgagctgcttccctgtgggatgtctgggaggtgagtggaaggccttcctagcaggcacatactggaacataatcaatccctcccatgcatacagctcacacccacattcttatccattcccaccatgcccctcagtggcctggggagactaggaataccccacttgacagataaggaagctgaggccaggggaggtcaaggcatttgtctgaggttgcacaaccaggagtggtgaagctgggagtcacacacaaggaatcactgcaaagtctgtgtccttcccactctgagtaggacttgaaccagggatgtccgatgctgatgcttgtgtcctgaccactaccttgcagcgtcctcacccacacccaccccaggcctgggaggcaggggagcaccagcggtctgggagtgaaagttgcttccctgtgggatgtctgggaggtgggtagaaggccttcctagcaggcacagctgcccaccggatgagtatgtccagggggagaggagccccctgtcccaggatgtgggcaaaaacctggagaagctgaagctggactttgaggatggcccctgaccccatcctgggacagccacctccccttccttctgccccctccagtccctcctctccttccctgctctccctcctacctctttccatctccccctttctgcctgtgattcctcctgtgactggggcaagatccttcacctctgtcctccctgagcctcagtggctcacctggaacatagggtgatgcctgcagaagtattttagggttactttatgagataaattggtagactgtttttcccgggtcagccagccaggggttcggtgaataggagcgaacgctgctgccattcccttctcccctagttcatcctggaggctctccgctctccccctggttctaagtcccctcctcctgcaccgtatcccccctcccatccaacccagtccccactgaggcactgagacagggtcttggcccagggtccccacccacctgagctccgcatgtgagccgaccttcacccgcctgcctcagtttcccgtccacgaaaggggtgagcgcccccacgtctcctgggactgtccttgggtccgatgcggggctgtggggaggtgccagggtgtgggcgcagcagggagcgggtgtgttaggcccccgcccatcccgcgcccgagccccatctggctcgggctggcacctcgaatccacgtgatttctcggcagcagccgccagttccatgcactggcggagcagctctaggcggcggcttctactttcagtttcgtgcagagcgcggaggagccgcgagcgctgagggtgagtgccgggagctctgagggtgagtgccgggcgtgccgcggggctgcgggacccgggctggggcgagcggaagggagaggatcggggttcgaattctgcacggagaggggtggaggggatgtcagaggccctggagcgggaggtgcgggtggccgggtggctggccgatggatagctgggtaagcggacagggcgccagtggcccggcagcgcgcacagcatgcgccccggcagtttggaggaagag

SEQ ID NO: 17702 - DNA, 24678 bp, Homo sapiens
  misc_feature (1)...(24678): n = A,T,C or G, or insertion/deletion polymorphism (see Tables 1-2)
gggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgccccygagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcatactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcatgtgccccgccgccttgtacatattcccacccggaataggccgggatttttactcgggccgtgcccctcttccgcccccatttggggccaggccggccggacagacggacggacggacagacctccttcctaagcacaatagcaccagctccccggagcaccgcacctccacaaggagaataaatgccactcttgatagaatttggagtgtcgggctgatgtgtcctgggctgggcccacgctgttgggtggctgggagggtcttcccagtctggcagtacctcagaggctggtgctgcaagggtcagcctgaggcctttcacaagacggccctcttcttccactggggaggacaggcttggcaggcccaaccacaggagcatcaggtctgaaggcaaagtagttggcatttcccctggggtaggtggatctgctccacaccaggaacaggagcactaaggggttccagtctaaagtcaggccaagcccacggttggaccagagtgggcagggtaggtatagtaggagctgctgttccccagcctgggtgccttcgctcttctctccctgaaggagctttatgctgtgatggaaggcctgatagccacctcaagccctctgagatgctgttgcaggaaatggggacagtggagagttcgaggtctggcccttttcctgtggcctgctgcccacattctgacccccaggcttcccagatatgctcccccagtgtctgcggatgcctccatggatagctgggttggaccggttccagggaggaggtgcccagggggcagagaggcttctgcaaccatcgcccaagggctctagacagaatgagtagtggaggagataagggacagggaccctttgcccagcaatgtcccctggtaaccaggtaggcaggcatgagccgagaggcccaaagtcttcgggcacatacattcaaaccaggtcagtcctagatccagggccagcaaagctgcccacaccctagcagggacaggggacagacctgcccagactccactagggtggagagcaggggaaccaggtctgcagcatgtcatggcctgtgtgcctggcacttggaggagctgtggtgcaggtgggtgctctctttgggagagcactaccagcaatgacaatggcagacagcaatggccaggaggaaggctcctagcctcactccttccaaaggactccaacagcgactggctgtttctacttctccaggattctgatgcgtagagtgggtggaaggatggaggtggcctccctgaggcctgggatgagctcgaccccccagttcctcccagccacagacacaagtttccctctgaatgagcagcacaggccatagaccaccactggctgtgaactctcctgggacccttgcttctcacaggccttcttggcccacccatggcccctaggccctgggatcagcctgaggccccaacccacttccagccctttattccactagccctggaaggcaactcgcttcgggcttgggccccctcatttgttgctgcccccagcagggtgatctgcatcatgctttcctcgatgacccagccatacacacccttgtccccaaccaacctcacctaccctgaccattcccctcaccctagatcccagggtatagggcctgtctgggcagggcttcacccacctctggagctgctgccccgccacgcccccacccccggtggcaaagcccttccttaatggcccgcccacagccagtgctttccccattggctccaagcctggctctgctcaccaggcccgacccatcctccctggtggtccagtccaccctcccattgtctttctcctgtggccacttgccggctttgagttgggacgcgaccacaggttgagtcgttgatctcctctgcctagcatgaggtgctccgtggccaggtccagacctctctgagcttgctgtcagtccatactcagacaggtctgggcctacctggccacagagtgtgtctgccagcgactgcattcaacaaatgaatattctgagagactgggtaggagatggggctggtcctgaccgaccaaggcccatgtgtgaggggctcttgggtccagtgagggcggccccactcggcaggctacacaaagggcatctgccaggtagctccagcctgcctgatacctggttggcagcaacccacagcggcctgtggtgacaagaatatgtcaccaggggggcaaccaagggggcagccctgctggccactgttggtggaggtggtggaagaggacggagctcagaggcgaggctgtgaccagcccacgggagaggaccccacctcaggaggagcacctgtttgcttccagagaagtgctgcttgcccctgctcaccccagaggaatgaaggtgtttctagagtcagagtcctcagtgaaccctggcatcctgagatccaggatgttctcactccatgccctgtgcaatatgcacaccaagccaaggtgggccgcaactgtggctgttacagttgattagttgcttcatttaacatacaagatgtctggggcagtggctcatacctgtaatcccagcaccttcagaggccgaggtgggaggattgcgtgaggccaggagttcgagaccagcctgggcagaatagcgagacccccatctttagaaaaaataacaacaggccaggcgcggtggcttgcgcctataatcccagcactttgggaggccgaggtgggcggatcacgaggtcaggagatcgagaccagcctggccaatatggtgaaagcccgtctctactaaaaacagaaaaattagctgggcgtggtggcacgcgcctgtagtcctggctactcgggaggctgaggcaggagaatcgcttgaacccaggaggtggaggttgcagtgagacgagatcgcgctactgcactccagcctggcgacagagtgagactgtctcaaaaaaagaaaaaagaaaacaaaaaacaacagggcggttgcacaggccgtgcaaatgcacagaagcctcttgagtcccggcgatccagcggcccagacttctgacatcctggagaggctggcccacgttggaaactgggaggccctgagagttgagggacgtggagctccttgtggagagagtgggtgggctgagaagacaccaccaaggggcctgcgccctcgccctcgccctcgccctcctctcgccgggctctgcaggcccggaggtggagagcctgggagtcgcgtgcaaggcaggcgtcccggtgacgcagggcctggtgcatttctccagcttggtcttctgacctggcccttgtctgacgtccccctaaggcgaagaaaagcaggttcctgccggggtaaccagagggctcgcggagcagaagcgcgccagggacgttactgtaagctgcgtgcgcagaaaccaacgcgctgggtggcgggcgacgcgagccgccgcggacaccggcccggacagctggaccgtggcgcactaggcgcttcctaaatgattgcccggagtgactcgccgagaccccgtgtgtacacaagtgggacgaggggcgggcgcacagcggccaggaagtcggggcccagcgcacccctcagcggaccatcccgctccgtggggccggacaggaccccgggaccacgcgggagcgatgcaaggtccgttcccgctgcgcgcacttgcggcccgcagccccggccctgggagctgccacggctcccagggtgttctgcgccggtgcggccgcggcgactacgactcccagggtgctctgcgccggcgcgcccgcggcgactacgactcccagggtgccctgcgccccgtcagcctctccaggccccgcctcaggtcggccgcggactacaaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtagcggagcgcctgaccccctaacctctgacccaagggccccgcgactttccggggttggccgaagcgcgagctccgagtccgagaacatgggccctgggctaagcggggatcggtgtgccctatgggccctgtggggaaactgaggcttggggagagtcacctgacaaggtcactgggtaggggctctggagctggccttggccaggcagaggggagccggcaggtgtcccgcatccagatcctcttgggtctgtgcatcctcaggggctcctgaggagcttttcgaggggcgggctggtgggggcccggccctggacagtgtccccttatatggaaggagtcagataagatctgggcagtttgtggtgataggttccttcttggtgctatgagcggtgccttgcgggtaggaaaggctcccagaggagggctggcctgccagggagggggccagaggagcccaggcctgtccgaggacaggggaatcagcagctgccccggacaaggggcagtgttagaggcgttcttgtccttgcagacccttctgagagtggctgcgtggcccattcattgctccagtggttaggctggcctggagccctgccgatgttgccagagccagcgtctgttgtagggacagagagttgggttctgtgttgggacttccatcctccaggtggggagtggggtatgggggtggtggacacacctgcaggcgtgtgccctgctcagctggatgactgacagagaggggtggagggagagaaccatggccgatgggaaggacttggccagcctgggcattggcttcctccaccaagctggccttgagcaatccccttgccaccctccatcccccctttatggcctttaccctggcccaggggccctcagggctttgttttagagagcagctgagggcctagaggttatcaaggcagaagtgggctgattttggacatgtagttggcaatgatttgctctctcagtgagcaagaacagagctttccttcacggggcaccatggggagggggttgggggagggcaggcactgtcgtggccctcagggtgctcagttcatctgggagataagataacctcagcaagagtcaggcatggagcaacatggacaaaggtcgggcacggaggccttgaaggggccgtggggaggagggtggccctcctgagaggggtgcttgcctgctgtgggcctggggtgctggtgagggaggctggcctaggcacctcctacctgaaaaggaggtgtggctcctggagttaccctctctccaggaggcagggggatggctacatgacctgtggaggacgtgggaattgagatttctttttttttcttttctttttttttgagactagttttgctcttgttgcccaggctggagtaaaatggcacattcttggctcactgcaacctctgcctcccaggttcaagtgattctcctgcctcagcctccagagtagctgggattagaggcgcccaccacacccggctaattttgtatttttagtaaagatggggtttctccatgttggtcaggctggtctcgaactcctgaactcaggtgatccacctgccttggcctcccaaagtgctgggattacaggtgtgagccaccgcgcccggccgggaattgagattttttttagtgtgagatgagggtagtcccagctttgggccaagccgccacctgggggtaggcaggggagagcagtcaccttcttgctttgcaaaccagcaaggctttcctgtacttctgctggtgtgggatgggtgcagagctcgtgggagaggcctggtgagtccctgtccctgccgtggaggtcgggtctccttgggaagaggggcagtagatggagaggtgaggccttcatggggctggaggctgagaccaaaagtctatctgctcctgggtctccaggacttgcaggctatgtgtgcttgtccctcagacctagggatgcagcagggctcggccactggctgtggacactgggctcttctccctgctgtctgcgtcaggccttgctctgcctgccctcctgggacttggcctctagcgcacccccttgtcagcctcacagcctcccctccctccagcttcctgctgctcttggcccagcccagcctttcctctcccgcttcctcattactccttgagctcgggcctcctcccctcacggacacttcctgctcacctagggctgggctctgggtgtgagctcctttcttccggccccgtggcaaggtgaggctgtgaggcaggcaggagagggcacccctttctgctctgcttgtggctcactcctgccaggctctttgcacacacccaccagccctctgctcacaggcaccccagtcggggccatccggtttctggcttctcccagggtgttttgtccctgaggtgtcctttctgactctccctttctctctccagcagggtctgcgaggtgcagggagcctgccccaaccatcttgaacccaggcccagcccagaggccagagtggaggaggcggcagtgagcagagctggactctgccccctcctcattgtgcttggccctggagctgcactgtgtgggccccaagtgtgggactcactgggacctgtgcctttgggcacactttgaacctggagacagggtggcgggtgggcatgtgccaaggtctcagtgttgccgtgagactgagaggatcctgctggctgggtgggcctgggggctgcaggagggagggcaggctgctccgagtcttcttggactagggagtgggtgtagggacagctggaaggtgcagaggcttgggcagatcctccagtcagtgagagggtgataaaggtgctctaggcacaggggcagatcccacctccccatgccgttccatgcagcctgccctgtagcccacatgctgctggccgcactgactgcttggagctctgtgggcactggtggactggggcttcctcctcatgggggcctgtgaggggtaggggtagcgcagtgggggtgctgcctctgggtggggctggtcaggcctgtgaagggcctgaggtgaggctgtggctgggttgaggaaggccttggaagcctgtcaaggggcccctgagaaagcttgtgtaggattgtctgcagtgagctttgggaagcaccaccctttcccgactcctgttttcatcttggagatgggcatggataaagccagcatggtgtccttggtggctcaaagggggcaggggtcatactgctgtgaaacagctgtggttggtaggtcgtggtacaagaaggccaaccctgaggcttgggattgttctgctgaaaacaaatgggctcgaacttggggaagagggggcagtggagaggcccccagacagacagcccagagaggctgctgggcagttgggcctcgtgcccctgctcccgtcacggtgctggggctctggcggtgtctacacccagcctcctggttgtgggcaggcagtgagtggagtaggctggggagatgagccaagggcggtggtcagttgggaagacagctgccaacttggggaggagggaggctctggtggagaccacagcctcactgcatggcccaggatggacctggtgggtggatgcagggcgctcaggctggagctgggagaggcaggggctgggtggagctgcctgcccctgtgttccagtctagatgggcagagggaaaggtgtgagcatcctccctgcctgggggtcttggggactagtgtagacttgtccaggaactgtgtaggtgtagatggggcatgtgttgcaccaaccttggtcttggggagcaaaggttgggcttgttggcattgcctctcggcctccctggccctttgcctcctgggcagggccgtctgactgccgaccccaatcctagccagcttgccttgggtgccctgagggcgtctgcctcatggggctcctgccatggctctcaggcccactctccctgcctaggggctctgaggggcagatgtgcgtgtgcgggagggaaagggaggctctggcctctcctctcacaaagttgaggacttgctcaatgctgtgtgtggtgtcccagtggcacggcagatggggggtgaggcgggcctgcagctagtgtatgtgagccagcactgcttcctaggacgtgtaggggcctggccaagctcttgctgtccttgtcctagctatatggcagtccctctattgggctgggtgccctcttccacctgtgcagtatgctgaggaccaggcagggtctgcctgtgcccctccagcgctggttgggagatcatgggtgggtgcctgcctctgttggaagcttctcagccagcaggcacctagccccgggtgggttcctttcagccccctcagcctgggcacacatcacaaacaagtggaggctacaccggcacacgagggctggatccctgcctctgggaaagtgcatgtcaggctggtgtgtggctggcgcctggcctgcctttgccagtttgagcctgcacgtccaagtgtggggacccctyagctcccgggtgctgggatgggccaactgaatagggtggactcaaccctcaccacttggtccccacagtgctgggcagtgccccctggtccatccccaggttggaccctgcttgtggccccagtgctagtccacagccagagtacatggcagtggccagaggcctctggagagtgaggcctggagtgtccaagctccatgtaggtccagtccgggcagggccagctgggcttgcttctgaccctgacatgctcgtcccgctgcctggaggtgcaggctctgggggtccggagagctttgcccactgtaggtcttgaggccacagtgtggctctgcctggcttctcctcctggttgtaaataaggagtggggcctgagggcagacgaggacactggggtgggggcctggatcctgcgggggtggcgctgccctgctggtgcccactcagggggtgcttgtgttgtgctctgtcaggtgccatcgcctgcaggattctttattcagctctgacagtggcttcagcaactaccgtggcatcctgaactggtgtgtggtgatgctggtgagtgggacatggtgtcgggagcgggtctaggtccaggtggggctctgtcccaggctggcctttgcctgagaacaggctctgtcacccagggtgtccaggctggagcccctstgggctggggtgtgtggagcaggctgcacctccatgtggctgccagcactggactgttggggaggggagtggcagtggctgcccctgctgtggtcacttgggtgcccatgcaccacatacttgctgcttcccattggatcccaggagagycctgcagatgtggtgtgggcgtggggaggccgaacagtgcctggctggagcctgtgtgttgtgagctgggcctgaggggtgcagggcctccagggagggcagggtggagggggtcttgccctgggctggtgggagagtggactgcatgctctgtggacacaaggcctctctggcaggggatgtgagaagagcttcctgtgctacgccacatggcctctgtgggtatggagccctgcaggcctggccaccactctgcagtcctcctggnnnnnnnnnnnnnnnnnnnnaccccagaagtagttggagtctagggctcaaaggggcacctgcagggcaggtcggggacaagggctatctgggcccagcctccccaactcagggctgatgtggctcgaggcctttgaccttcacccaggcgtgtctatctctggccttgggtgctgctcctgtggctacccacgtggaaggggctccacgcacatccacatcccccaccgcccatggtcctagaaggttccctgggggtggccagctgtggaggcccacgagtcctggtggctgagaagctggccaggcaggaggacagtgggcccagcgccagcccagcactcaggagacgcagcccattcctggcccaggttgggccttgtccagcccaggcagcactgtgtattctccccaaccccttgggcctgcctggccctttggcccagccctgaagccttttccctgctttggctcccccatgcccccaccccaggcatgtatcccgctctgggctgcttgttgcattccttctgtggcctgggcctggaggtgggtaccgtccattggcagctttggcttctgcctgctgtcagccctcgggagaggccagtgacagtgtgggccacgtgtccatgcagaaggcctgtgtgtcagccctgcggccgggggaggcggggcagtagcccttgtgtctctgaagcagtcttctctctcatgaagccttccctgaccacccaggcaagacaccctcagtgttcccttgccagcgacccttttccccagcaccagttcactaccgcatgaggcccgagctccgggtggtcagccaggtctgcggcattggggcccagcttaatggaggtgttggtagtgcttgtaagatggaggaggaggttcctgtccttgcagagggaggccaagcacccaactccaggctcgtcccaagagccttattccatgggggctcagtcctgggaagttgctttggagccaagtgtccaaggcttagagggcggcaggaagcagaagaggcaggcggggcacaagccctgggaagcactccaggcccagccccccttgcgacacagctggacactgctcctgcagagaaagagtagacaactccccctcttcagccttggccaccagtagggactggttccttggggctcagccgtgggcaggcctccctgggcaggcctgtattctggggctgtctctggggtgtggttggctgtgggagccttgggtccctcactggctcggctcagcaggagggatgtgagcagatcagcagctggtctttctgctcctgaagacccaggcgtctggcagggttggttggtctggccggttggttccctccatgtgggaccgtctggtgtgatggggacagggagggacttccccttacccagcactggtgttggctgaggtgggtgctgagtctcagagcttggcatggagaccagacagggctgggtctgcaagcctgaggctgccgccctgagctcgggctgggacgtgcccagaggtgttgggaggatctggggtgagtaccctgtggccaggactaaaggggctgcaccctcctgtccatccctcgcagatcttgagcaatgcccggttatttctggagaacctcatcaagtgagtgcctttgccaggtcccacccctgccccacccatggcctgtccaggccccgccccacagccccacctgccacccactcagacccccatccctccacccccaggtatggcatcctggtggaccccatccaggtggtttctctgttcctgaaggatccctatagctggcccgccccatgcctggttattggtgagctgggctctgaggagggcctcgggtggggatcaggctgacgtggccctaaacctgccccttggtgcttctgtccacagcggccaatgtctttgctgtggctgcattccaggttgagargcgcctggcggtggtaagcagtgcccctcacctccgtgtgtgctcaccctgctgtgtgyrctcctgggaggagctgctccccaggcctggcagccctctcccaggcaatgggagccctggttgagtgctctgctccccactccagggtgccctgacggagcaggcgggactgctgctgcacgtggccaacctggccaccattctgtgtttcccagcggctgtggtcttactggttgagtctatcactccaggtgcgcccccatcccaccctgcccatctgtctcgggccagccacgggcatggcctccggctgtggcgctgtggaggcctgagtccacctctcctgcagtgggctccctgctggcgctgatggcgcacaccatcctcttcctcaagctcttctcctaccgcgacgtcaactcatggtgccgcagggccagggccaaggctggtgaggggctgccaggggctggggctgcctgctggggggctgggcagcagcagggccccaccagccccctcccactctgctgtgctcgtagcctctgcagggaagaaggccagcagtgctgctgccccgcacaccgtgagctacccggacaatctgacctaccgcggtgaggacctctgtgggcctgaggtgcgggggacaggctgggcctgttctggtaccaaccccccattcccattccagatctctactacttcctcttcgcccccaccttgtgctacgagctcaactttccccgctctccccgcatccggaagcgctttctgctgcgacggatccttgagatggtgaggttgggggctgggggcagccactggaggctagggggccttctggctagccagggcctcagctggctgctctctgtttcccccccagctgttcttcacccagctccaggtggggctgatccagcaggtaagtggggtagggcagggttgggtgtagctgggcatggctgggagctgacgtggtgccctcctttgcagtggatggtccccaccatccagaactccatgaagcccttcaaggtgagtggctcaggtgctcttgcagctggggtggctggggagtgaccaggagcatggctagctgaagggcttgtttctgcaggacatggactactcacgcatcatcgagcgcctcctgaagctggcggtgagtgcggacaggtggcgcatgcacaggacaggaggggacagtggcatgtgggggaaggttctagaacttggtgcccacccccacctccctgccaggtccccaatcacctcatctggctcatcttcttctactggctcttccactcctgcctgaatgccgtggctgagctcatgcagtttggagaccgggagttctaccgggactggtggtgagtgtccctggggtgtccctgggggctgggatgggccatggtgtgctctgatccccctgtggtctcttggcccccaggaactccgagtctgtcacctacttctggcagaactggaasatccctgtgcacaagtggtgcatcaggtaggtggggtgtgtgtgtgtgtgatgtggaacatggctgtgaacctgaaccgctttccatgccccctcctctgcagacacttctacaagcccatgcttcgacggggcagcagcaagtggatggccaggacaggggtgttcctggcctcggccttcttccacgaggtcagtgctctggggggcatcttgcctcatccctgggcaggggtatgcccacagcagggacggctgacaccccactccctggcatcctctctccctcccatctcagtacctggtgagcgtccctctgcgaatgttccgcctctgggcgttcacgggcatgatggctcaggtgagtgacccccacgtggcctcctcactcgcccagttaccccgcacctgaacccctcggctgaccctccccatgcccagggaccctgaagcccccagccctgtggtcaccatggccgactgacttggcccctcactccctagatcccactggcctggttcgtgggccgctttttccagggcaactatggcaacgcagctgtgtggctgtcgctcatcatcggacagccaatwgccgtcctcatgtacgtccacgactactacgtgctcaactatgaggccccagcggcagaggcctgagctgcacctgagggcctggcttctcactgccacctcamacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtcccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccaggggcctcatcagcaacctgctgaactggtggtgtgaggggagggtgggctcccttggtggtatcctccctctaccccagtgggggctggtgggccctgagatggaggcatctccttgggccctgctgaggatggcagtagtgggtgagctcctggtggggggatgggtgtggggccgactcctccatcccacatgggctcctgtgcctctccctatcagttggccagtggagctcgagaacaaactgttgctgccagataaagcagcaaagcctgctccactgcccagcgcargcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagccyggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaacctgcagggtcagtccaggtgtggctgtgaagccccaaccaaaccacaggacacggggttgggggaaggcagactggcaggccagggtgaccctcctgaccagaggtgctgcccagacccgagcccgtttgtcctactggggctatggcggccgacccaccagtgcccaagaccgcgaggctgccctgcctccccaagaccagccctgcactgggggtgggggtgggcggctggcccagctcctccggggcctctaggagacagtggggtccttggctttgggaggctccgagcctgtcagcagggagatggtggggtcctcggcgaagccgtccccttcggagaagtaggagccctctcccagctcaaacagcaccggcaggtcgttgctcccggtgtccacggagccggggtccagcaggaacagcggctgcgctgtgtagtgcaccagctgcttccctgcgggggtgggggtgtcaaggcggtggggggttgggggcagaggtggggccggtgggacttggctcacctgaatccgggctgctgttctctgcctcgggaggcctggggggctcctggggagacaggagctcttggatctgtggggtggagacggtattgtgagcactcccgctggtctcgttccccctcaccccccgcccgcctacgcacactggccaggctgctgtcaaggtcaggcaggctcatgtcgggcacggtcaccgaggggctgaacagctgcggaggagggagggaagtcagaacagcacccgggggcggggcggggaagcggggaggcggggaggcggcgcggggaggcggggaggcggcgcggggaggcggggaggcggcgcggggaggcggggaggcggcgaggcgaggcggggaggcggggaggcgcggggaggcggggcggggaggcggggcggcggggctccactcacgtccagcagggcactggtgtccacgctgaagccgtggctgctcagcatggtctgcaggttatccaggttggagtccatagcatccaagtggtcactgagctcattcctggcccgggataaggcggtacctgaaccagtgccccaggccccacaccccaatgccctcctgtgggagaagggctccccttgactgtaccccccaggctgcacccccgtgtacgcctgcacaggctggagggggcagcgcattcgaggacggcctggaaggcagtggaggctctgtgccctgcaggggtgcggctgggcctatgctgggcatccctttgccatgagggcctgggggccttggtggcagtggacccaggagacaaggggcgtattcagctccagcacaaggatcagggatttcagtgttcagggttggtgaggtttcccgttgcactgggaaaacaggtggggctctgctcagtgtgtgggtggctcagtccctgccctggtgctgctgtggggatgagacccacggtctggtggctgtgaccaagaaagccctaggccacagggcacacctgggctatgggacggacagccaggctgggtcccagaggtgccctggagaccctgcctgacaggaagtgcagtcagcaccgcagtctggatcctgccaacaccagaggccgtgccagagcagggaggcctgtccctgtcatccctgtcacaggcaatgaccacaggcccgtggccaggggagccatgacgacactgagcccccgccacagaggggtctcggctgctgccgcccaggcccgacgctcatgcccggccaggctgggtctggtccacggctgtgtgggagggcccgagcgctggcagagccctcctccctccccagtggggtcagcgctaaccctggctggacttggccatgcggagaggaagaggggcaggggaagaggcgggcgaccctagacatctgtggagtgcgagccaaactgcaagatacaaaaacaagagcccccattgcaggcaggggctgggggtgtggaggccggccctgctcaccatctcctgccatgtgtctgggcagcacgacctgccagggcccgtggcctgtggcgagggtggcggcagcaggaggggtggctgagagcagggcccggcagcctgtccggacatgcccgtggcttctgtggcgtttgggactgtggggtgatctggctggcacctgtctccctccccagccccgagccccgaggttgggggtagggtcctgcctcgccagctgccctgctcagtccactgggacagtcggggctgaagcccagggctgtgcgtccaggcgctgtgggtggggccaggggtgggcggcactcacttgtccaggcaggctacgctgaggcacttttcaggggtggaggtgggcgggggggagggaggccggccctcggtgtccgtgtggcccctggcgtccgtgagggctgtgacggaggcgggggcaggttcactctcccgcaggatggagtcaatgagggcggtcggggacaagagggtgtccacggaagatgggcgcccgggactcgcctcctctacccgggggctctgaggcgggctggggggctcctccttgacacgcaccagggggctgctggataggggcctgcacacgaggggggccaggtgagctggcgtctcggccagccccacctcatccccaactctgccctgggcccacaggggctcgcctcattgggggacaggatggctggggtgatgcggcccccacctctcgtctatgctcccgccgggggaggccatggggctggcaggagccagctcggtgatgtcggagatgatgggtccagagctggccacagcatcaggggcgtagaggctggagctgctgtaggctggggagggggcctgcaatcaaaggcaggaggtccatgcagtgccggcaggggcaacccaccccactgccgcctgcatgcctgggcgggtgccctgtctccggcactcaccgagtaggggcccgagccgtggacgtgctccagggagaactgccggctatacttgggcatggaatgtgctgagccactgtcgttcagcatcagggggctgtggggaagggtgcaggtcagccaccaccccccacctcggggtacccggggcacagctgacagagaagggggacagccctgggccccgggtggtggatgcaggcatccccaaaacctcacatctttctcttcacccccaggatccggtttgactgcaccagtgagatcaggaactgaatgagctgtggagagagaggacacagttaccccggcccttgtggggcccccgccggccctctggccctgcccccaccttgttgacgactttctgttgctgggcatgcttctgccgaaggctggccacctcccgccacagagcctcattctcactgcaacagaccaggctgggtcagtggggcccaatcccatgagccccagggctgagggagccccacagaccctccctgtcccccatgcaggagcaggggtaagtgtgaccatgtctggcctggcccaccccaggatgagaacttgtgtgtggagggactgggggccagggccagggcttgctggtcccactgcccctccctgccggggacacctggtgtcacgtagggtgttggggatggatccatgcgagccaggtgcacccggatcctggcatccatcctggcaaacacctggagggctgccttggacacaggccaggagcagacccttgggccgcccttccaaggcctgagcagccaggttaagggaggacggttcttcaggctgcgacactggctgtcccatgtcctgtaggtgctcagggccctcgccaggcctggaggtggctcaggggtggggaagagctgtccccagccaggtgagcagggccatgaccgcgctcctgctgctctgggaggctgggccctgtcaagcctgtgagtcttcttggtaggccaggtccacgtggccggactccaggaatcacaaagccggtggctcctgctagaccccatgcaggagagtctgaggccaaggcctcctccatgacgtgggggtcaagagcgcctgctgcacggagccgaggaagccgtactggcattggggttcccgcatgcctggagccccaaagtggacgtgagacctgagctggccttccgaggtgggcttgcctcagtttctcaggtgccaccgtgtgttaggctcctgctaaggtttccccagagccgcagggtcccggtgaggaggggctgggggctagctccatgggcccaggcgagtgtgggacagcggttccaggaagggcctgaggtgggtctgaccccaggcccgaggcgggtgggacgggtctgctgtgcaaggcttgtcctcaaaagtaggctggtgggtcccgccaagctcggagccaggcagaagccaatggcccagagggcgctggggatgtgcagagcaggggaccctcccaacccccttctgcacatggaaaacggctggccccagagctgttgcagcagccacgggcggcggggctggggcagaggcccagggtagatgtgcgtggagcgggagggtggagctgagcacctggccccggtcagggccctgcccccacagcacccggggcctcttggtgggcgccaggacccgctgtggcccataatgctggtgtgggacctactgcttcatggccaggagcttggagtccatgcactcctgcttccccttcatcagctgcacgtccgtcagcagcttggtgacgctgtcctggcggatctttatgtcttcactcttcagggtggacacctggattcccgagagggacaggagtcactggagcagcctaggagcttggcaggctcaggctcgtccactgcagccaggtccctcaggaaggggcaggctggggtgggagccctcagggaggggcgggcggggagagctgtggcaggtgagaccgggcaagggtgcagggccggcactcacactggtcactttcctcttgatgttctcaaggagctgctcctggccacgcaggaagcatgggtgctggaactccgtgtcgtctctctctggcttgaccaggccgccctgctcgatgtggaccactttccggaagccatctgcacataacagggaagggggcagctctgcctcagggcgggaccagaacccctgaagagcggccactgctccaggaggctgctgcggggcttggccatggtcagaccctgccctgccccctcagagcccatgcctgggtggccgagtggccttggtctaagggagaccctgtgtccccacagggctccctgcgcccgacacacgtggagtacagctccggcttcacggttcttccatggggaccccaggttcatacccacaaggaccctcccccatggaagaggcggctgctccccggcccccaggcttgcagggtcccacgccatgcccttggccagcacaggacgccccgtccttcatcacagggtcctcctgctggggtcccgccatctgcaggtctgcctcccgcacccctgcgctgcctggaggcagcactcacacatgttgagctgccgcacgaagctggccatgttgttgtgcttgaagtacttgggcagcacctccttggcaaactggccctggtcgaacacgtggaagctgttcccgctctgaaagggagacacatgggtgggtcacgcgtggtggtgaggggcagcgtgcccaagccgccccttccccaggccgccccttctgaaacgcaggcagtgcacgttccacctgatggggctggggccatgggaggcccagggggctggcgggaggcgagttcgttcctgggaccacctgccacacgggcctcatctgtgcagcgtgacctgcatcctcactgtgaggcccaggactgggcggtgggcagatgcgaggccttcctctcagtcggaaagcccctccccagggcttccagagaaggccacgtttccactcacaaagcatccgccgcactctggccacatttccactcacaaagcacccgccgcactctggccacgtttccactcacaaagcacctgtttaagcaggacctttcccttgggaacagcgaaggaaatggagccctaatttcattactcccgaggaaaacacagtcgcgttcagaaatccaaattcagtcttgttttgtgacgtgagacaagaaacagagacagtcaaacactgcatataccttcctcttccatttctctaccgagctcaggcccagagctatcaggaggcgctggtgagggaggcatccctgttggccgtggccgcggtggctcagaggggacatcgaaggcttaggggacagcgagaagcccacacggcggggaaggggggcctgaagcagggccagagaggggtgaggggtgtctgcataggaaggggcggctgactcagtgaagaaactggtgaagggcagtggggcaggtttctccctgc

SEQ ID NO: 17703 - DNA, 34966 bp, Homo sapiens
  misc_feature (1)...(34966): n = A,T,C or G, or insertion/deletion polymorphism (see Tables 1-2)
cagggcagggcctcggcccctcagctaaagcacaggacacgcgggcaggtgcatgggcgccacggcagggcagggcctcggcctcccagctaaagcacaggacacgcgggcagatgcacgggcgccatggcagggcagggcctcggcccctcagctaaagcacaggacacgcgggcaggtgcatgagcgccacaacagggcagggcctcaggcagggacttgggcagccagcagcgtggggaactctgaggaccgccccaccagcccggccggccttgccacctcaggccctgctggatgacggagcacacagaccacagacagcggtactttggaaaacaccctgcatggggcagccagttacgcagtcacagaaacccgagcagggcaatgggcaggacaagcacacactcagcagtgcagaggacctggtgctccaggggccaggagacaagcagcgagaagagaagatggcgcctccctagactccgcagacacctctagtacctttcaagtacttggatatgttattatgcgaaaacattgttttggtttttgaggcagagcctcactctgtcacccagactggagtgcagtggtgagatctcggctcactgcaacctccgcctcccaggttcaagtgattctaacgcctcagcctcccgagtagctgggattacaggcacgcgccaccacgcccagctaatttttatatttttagtagagacagggtttcaccatgttagccaggctggtcttgaactcctgagctcaggtgatccatccaccttagcctcccaaagtgctgggattacaggcgtgagccaccacgcccgctgaaagaatttaataaaaaaatcattaacatgtaaatgtgtaaatccttaatttaaaaagggacagaagacccagaaagatgtacaccagaccactaactgtgctcacgggttaggtgtgagggccctgagtgggagcttccaccctactgaatggtgctgctacaatatctacattattttccaggatgttttatctcataatttttttttgaaacagggtcttgcttgtcacccaggctggagtgcagtggctctatcatagctcactgtgacctggattcctgggctcaggagatcctcccactttggcctctcgagctgctgggattacaggtatgagccactgtgcctggcccagtattgtatcattttaaaaactcaagaaggggtaacgtagttgtccataatcttacaaaccactgccaacacagcacatcattttttctctgtgtatgttagtggtataattaaagcctgaattaagtgtgattttaaatcttttcttcccagcaaacaagccaacccaacacagctagcacacaatgaacaagccatggttccttggcttctatcacggggacctctgccaaggccgtaacttccagaacaccgaaactactgggagagtaaatccttacaaacgatttccagaatgtttagagtaacaaatgctgggctgggcgcggtggctcacacctgtaatcccagcactttgggaggccaaggcaggcagatcacttgaggtcaggagttcgagaccagcctggccaacatggtgaaaccccgtcactactaaacatacaaaaaaaaattagccgagcctggtagtgggcacctgtaatcccagctactcaggaggctgagacaggagaattgtttgaacccaggaggtggaagatgcagtgagccaagatcgccccactgcactccagcctgggcaacagagcaagactctgtcttagaaaaaaaaaaaaaaaataggccgggcgtggtggctcacctgaggtcaggaaatcgagaccagcctggccaacacggcaaaaccctgtctctactaaaagtacaaaaattagccgggcgtgatggcatgtacctgtaatcccagctactagagaggctgaggcaggagaattacttgcagtgagccaagatcacaccactgcactccagcctgggcgacagagtaagactctgtctcaaaaaaataaaaaataaaaaaaaataacaaatgctgtgttttagttaaattatgcttttctcctgttgttctcaataagagtagggtgcatcctcccccaccatcgctgcaacaggtacaatgttaaaccctctacccgtcggctgctcaggcccctgaagccctgtggggtcaggcccagctgggttccgttggggcccccatgccgcctgcttgagccctgccatgctgctcagctccctcctcagctgggtcctgccactggattccaagcagtaaaatccccacctcaaggaaacccaacctgttgccaggagggttgcccgagcatcgtctgacggggaagggcctaggcatgtggattttcagagttcctgggaacggcacgcaactggggatggaaaccagcgtcctagagcccaagcgtgccccaggtgcagtgaaggagggacgccggccttggggttctgagggacggtggagaaggcagtacagtggcagtctcagaaagcccaaggccacctgcacatgggggacagccctcgagggggctcctcgctcacccacctgcacctgctcctcagtggtctttttaatcccactgtggccctcgtcatcaagggctccgtcctctccctcctcgtcgccttcgtcatcatcctcactgctgtcactgccggaatcttccaggcctgagaacacactctcctcgctgtcggagacgccagaatcgctgccggtgctgtggctgagaggagaggtgcagaggarggggggctgcaaggaaacactgggttggtgacaactgcccctccaggcatggggcactgaacactgcagggagagctgcctctcgcccctccagccacccaccagcagctccatgtggcctccaggaccacacccctccagtcacaaacttccaccaaaagcatccacccaacctgagccttcctcatcttctacctccactgacaagacagcctcttgcctttgccatcgacattttaattcctagcacctcacagggaaggggcttttcaaggacaacctcctcctcttggagctcagctctcatcgcaaaactaacactgctctctaccacccactgacactccggaggccctgtggggtcaggctgggctggactccactgggtccctcagacagcctgcctgagccctctccacacctcaccctggcatccaaggccccagagccaagaggtcactagaaaaggggctgggggctggaagagaaatgggtccccaaagggcttttaccacctgaagcagacgcctcctcatttaaccagattgggaccaacgattgatcagtaaattgaaaggattggctgaagagtcacaggaatgatagagactctaaccgcaaccacgcaccaacccacccactcctctctctgagcaggaccacagctgcctctgagcagagccctgctggctgcgtgacaccggcacacacagtgttcgggtccttcactggccttaaagggtggaacaagaacttagactcttaggaagcagttgaaggccaggcacagtggctcactcctgtaatcccaacactttgggaggctgaggcgggtggatcacctgaggtcaggagttcaagaccagcctggccaacatggtgaaaccatctctactaaaaatacaaaaattagctggtggtggcgggcacctctaatcccagctactcaggaggctgagttagccaggaggtggaagctgcagtgagccaagactgcaccactgcactctagcctgggcaacagagccaggctctgtctcaaaaaaaaaaaaaagaaaaaagaaagaaaaggaaaagaaaagaaaaaggaagcagttgaatgcagaattctagattttactgttttcctaatagtttacaagtctcacttaaggtacgacctgcatgtattagctattgcataccgagtgttcacacaatgcctctctcacacagagtcatgatgtgtcttggtattcagtcggctacacaatcacaataactagtggaaatggcatccgtggcctgggcgcaaacaactggctcctgaggaccgtttagtccaagggtggaagtcgcagaacctggcgcctagagtggcctgcgggccattcagcccatgggagccaggatgagttgaattcgcttcacaaagcaatggggcagtttcaacaacccagmgcggccgcggccgagggggctgtgaggggctggctgtccatcccctccaccacccaatttgatgatccccacaaccaagacagggctgagctagcagagagcaacagtgagttctaatacagcaaatgcagcagacactgggttctattcaggttttcttattctcatgtctatcccatgagcataaaaacgcaattaactagcgtatacgtaggttaagcatttactgggagcgcaagccgagcccttttattggcaggatgcacaaatggaacggctggagaggctgctgcaaggggcgccccgtccccactccccgctcccccgtttctttgcttcccggacgccgtcctttaccccgcagtccgctctgcctgagaccccccgatagaggagctgcacccacgcccaagaccgattcactgggcgcgggcgcccaggtgacagaagccgggcccacccgccccagcgcggccacgtgcccgccgggccctctagggacgcgccccgccgccccgcatcgccacagtcacctccggctcgggctcaggctccagttcgggctcagaccgccgcttctccggccgcacgctcggcgccgccgtgcgccccgcaccccgcgaacccgccatgccccaccgggcgccggccwccacccgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctacggggtgctgggtcggcaactattaggagaaagtcaggacttggcacgtgaagtggagggcgttgctgtagtggaacaggaaaggcagtggaaacagtaagacgtcatgaagcttcaggttgatctcaagcccgtttccgaatcccaaatctgggtttcccaagaggagttttgtttttcattccttatggggcatctttattcgtgtttctgtcttcagttgcctggcagcaggcttgtttacatggtccgaccctgcaagaccggacagctccggtttgcagaagtaaatcagtgattgtctggagttggagatcagaatctgctgttcacatcccggctgtgacgtcgtgtccggtgaggggcagagccaccgcctgcggctggcaagtgatgacctgaagaagggccacactggccgagtggggtgactcttgcttgtaatcccagcactttgggaggcggaggcgggtggatcacttgaggccaggagttcgagaccagcccggacaatatggcaaaaccccagctctactaaaaatacaaaaaatttgccgggcgtggtggtgcttgcctgtggtcttagctacttgggaggctgagataggaggactccctggacctgggaggcagaggttgcactgaaccaagatcccgccactgcagcctggcaaagagtgagaccctgtctaagaaaaaaaagaaaaaaaagaaaggccactgatcattgggagcttttggaggcaccgtgaccggcagggtgccaccaagcatgtgtggcctcccaggagctaagaccccagagttcttcaggctctgctgagtgcctcccatttgcacagcctctttatgctgttaggaatgaagaaaagtctaaactgaagctgccccaggcaggaggccaggttttctgcttcttgggtttactgaggctctgctttacctacagagtgtttggaaataaagagaagactggaaatctttgctcttgttagaaacactttgtgtttgtcccgctgacacctctgtgttggccttcccatccccaggtcccattaaggcacagtgcaccttcctggaggctggcttcatttcaccatctcttcattctagaccttggattcttgtgcaaaggaaatactcccatgtttctgtcttcttttatccgtctttttcttttttcttttttttttttttagaccgagtcttgctctgtcacccaggttggagtgcagtggtgcgatctcggctcactgcgacctccacctcccgggttcaagcaattctgcctcagcctcccgagtagccaggactacaggtgcgtgctgccacacccggctgattgttgtatttttagtagagacggggtttcaccacattggacaggctggtctggaactcctgacctcaagttatccacccgccttggcctcccaaagtgctgggattactggtgtgagccactgcacccagcccttcttctttttcttattccccttaatcctcagaagttaaggggaataactcccccattgggggaggggcatccgmgattatctgggatattctaagcttaatcctactagcgtgatctgtcctgtcccgtaatctgcttgctgtttctgcttaaagattatgaggcatgtgggttagggcccagtgtacccttttttgggaccgaggcatgttctgggcagggcttttgagcaaggaaggcaggtgtgatgaggcccgtggccagcctccactccactcacaggtgcaccacctgtggatctgttctccctggggagggatggggagccaactggaatgtgagtgtttggttccacctggtcagtatgaagtggcaatggttggtgcaggacgtagcactgggggcgagcatggcaatgagacagaaacactgacttaaaactggaaggaagcccttctccaggccgcgcagggggctgcagagctttccggcgctggctgcctggcctggagaaaggaggtgatcatcccatcctgtgactttgagagcactcacacaagccctgaggactccctgtcagcagagtcccaacagggcaccctcccacaaatctactgcccaggcccagctggctctcggaggccttgagaaggccctggtgctcttgctctctgctgccttctctgggagagtctccttctggctcagagtcttaccaccattctgccaagaaaaaccctccctatttgacacaagaagatgaggcagaatcacaggcatggtgactaactctcaaggctgaataacctgggggagaccgaggcccagaaactggccagtaactttactgagcctggccaggaatgggaccaggtctggaccaccattgcacgtcccctccctggcctgagatcaggactcccactgcagccactggaggcagaatgccgggtcactgcccaggagaccccattggtggggactgtggcagctaccccatccctgtgttgtttgatttcccacccccccctcccaagaccctcattcccatgagcaccccacccacacaggcaagggccttgaggggacccagcaagtcgtggaggacagcacagccttggagaggaaatgtgtcagccacaaggttatgatcccggggatccacataagagcatgggcgtgcacgtgggtggtcctccctcagccagcttctcaacagcttctcccaaaggtacacctggatccagtaccactgagacccaaagacggggttgggggactgaatacctggactgacaggcacctccatagaactgagacccatgagacccgggacccgcagcctccctgccccgtgccctggtgccggccctcagcccagcttcctcgtctgcatgcagcagctcctctgtccaccagcrgaggctcttctagggccttgctgggctgcagctgactcaggagggcaacagcctcttcagagaatttgacagcatggagaaccaaacaaaagcagaaagtgaagcctcagaactgggttcaccatcatcccagttttttacaagctatgattttgtcccatctttattaacaagataaggaagtatgaaaartaatctcgacatctgagatggtgagattacagccccaggagccacccagctggctgaggagcctgagaacaaggcacagccacatgacctgtgccagacaaatgctagaatgatggtcacgcaggttagaacgaacccaggtagacggaggcctcaggatcagggtgaggccagagggggcacctgggtgcaaaatttaaggaagcactttttgttttttagataaggtctcgctctgttgcccaggctggagtgcagggctatgattgcagctcgctgcagcctctgcctcccaggctcaagtgatccagtcacctcagctgagtcactgggactacaggcttgcaccaccagacctggcttttttttttttttctttttaaggttttagtagagacagggtctcgccgtattgcccaagctagtctggaactcacgggctcaagccatcctcccatctcagcctcccgaagtgctgggattacaggcttgagccaccgcgcctggccctgaggcattcctttttaagacctacctgcattcggatggcgctgggagtgggggcctccttagatgtgggctcctggatgcttctctgtcttcacctggccccagcctcatgggtgcagctggaaagactctagaaggatgtgctgaaaccctggggctccctgagactgagtgagctggaggtcaccaaggccctcggcctatcgcgggagagagttccattgaaagccagtggtcaggtggccgctgtggagggtctctgggtggacaattgggagcagagtggtccctgcagtgaggcagggggcagggcgtgaggggtccctgaagtaaggcagggcagggcgtccactcataagcacacgaggagttgcagaagcagagccgacctggccacgctcagtcactcagaccctggccacagatcgtgtccggagctcccacggcaggcagggccacccctgcttccctggttctgagagccgccaagacccagcaggcccactggccccaccctggaagatctggtatttggcccaagatgctggaggccccacagcagcagctgtgagaagtgctgcagggtctggagggcctgatgtgtgcccggaccatagtgcctcctggtgtggccataagaaggcacacagctggggctggtcgtggtggctcacgcctgtaatcccagcactttgggaggctgaggtgggcggatcacgagatcaggaggtcaggagattgagaccatcctggctaacatggtgaaaccccgtctatattaaaaaatacaaaaaactagctggacgtggtggtgggtgcctgtagtcccagctacttgcgaggctgaggcaggagaacggcgtgaacccaggaggcggggcttgcagtgagctgagatcgcgccattgcactccagcctgggtgacagagcgggactccatctcaaaaaaaaaaaaaaagaaggcacacatctgtcctcatacagcttctgtgcatagcacagaaaaaattaaaaaggctctgtgctgtagcctcctgtgtttcctctgccccggatggtgtggtggggggggtgcggtgaggaggggcccagggcacagaagggctgagctgcagtggcctcctggggggaggcagatgcctccggtgccccatgcccacccaactccacaggctagtgtttgctcagtcctttattgagggaccagggatggacagcctggccctgaaagtctctcagttttggaggagtcagcctgtgtgcagggcgagctggagaggggtcggtggggctcacagtgccttcccagaggaagcaagcagctcccatcgggtatattgagggctgttggctccagggtctcctcaaggtctggcaggtggaggggaggctgtctaaggaaaggaggtggtcccaaatgtctcaaggcacctggcagcaagggctgctgctgcctcagcctcctccctgtgaccctgtgggccatggtgagcagcagtagccaccacacttgtgcacggcagccagtgacgagatgtgatgagagatgagggcgattgtgctgctcttggtccttgtgtggcgagaacacgctggaagctcctccagagcggaaacaagaagagtgtttatgagaaaggtgcgggtggctcagatgtggacagaaccagaccagggaacggggccacaaagtgagccactttgtctgcacctgctcgcgcttcctgcctgcctcactgcttccatgccctgactccggtggtccctgctccccacacgtgggccacagctactcacacacgcgctccctttgctcctaaagcctatactcccgggacccggagagggaacagccggccagccgagcccaggagcccagatcaccggtcagcagatacagctttgacttggcaggaggctggaacaagaggcttgtggcctgggctgtggggccaccttgtagaatacggcactgttcacgttttgggccagggagccctttgagaagatactcagagacacagacactttctatgtaaggtgtccctacaggcaggatctcacacacatttcaggtccttcacagtgctgcagaaaatgaggccacaggctccaagtttactgcaagctgcggggtttgctgacacctacacttctcagcgtgtggcatctcgcaccagccaggggcctcccatttccagtggcaggttttcgtgatatccagttatgaccggtgactcctccaagaggtgcctgtggtcagcagaggagggaccttgttccactgaggcaggaagatgagagagacactgggttctctgatgggttcaccagcagaccctgtgaaattcataatggcccctaaggtaggggttgcctgacatgttcaacttggatttaacccttaaggcataagaagccgctgaaaatgttcagacgttacaaaactagggccgggcacggtggctcacggctgtaatcccagcacttcgggaggctgaggcggttggatcacctgaggtcagcagttcaagaccagcctgaccaacatggtgaaaccccgtctctactaaaaatacaaaaaaaaaaaaaatagccaggcgtggtggtgcgtgcctgtaatcccagctactcgggaggctgaggcaggagaatcacttgaacctgggatacagaggttgcagtgagccgagattgcgccgctgcgctccagccacagagcgagaaactgtctcaaaaaaaaaaaaagaaagaaaagaaaaaaccggcgaggactgaggtaaaccacaaaattgtccaggctttttatgtggagggaatttgcagactcacgtgcagagaacccaacaaacccagactttggggcagctgaggcagctagaatgtgtggggtgtggtaccagaaaggaaggagttacgcccaaaacaaagagctccagcaatctgcgtgtgagcccgcttgcatcttgggttggatccgatttgctggtgcacacagtgaaacctcgtggagctggaccaagagcaacttgaaggggaagagtaagtgtaaggggacagatgagcaggactcacacagggccgtggttatttcagttcccaccagccagagtatagaagccactttaaatacaaggagctttcatgacaccttagaggaaacacagcttggaagtggcgcagaataagctgcagaggaaaggccactccaatgccgtggaaacaagtgcaaggcaagccctggaaacaccactgcctgctagcacggagtacacacagcactcttgagagaaggaagccaggcgaagtggctcacacctgtaatcccagcactttgggaggccgaagcaggcggattatctgaggtcaggagttcaagaccagcctggccaatatggtgaaacgccgtctctactacaaaaaattagccatgtgtggtgatgggcgcctgtggtcccagctacttgggaggctgaggcaagagaaccacatgagcccgggaggcagaggttgcagtgagccgagatcgcatcactgcacttcagcctgggcaacagagcaagactccttctaaaaaaaaaaaaaaaaaattcacgtccagaatctaatcagtcatgggcagacaagccaaagcagaaaaatggacttgtcactggagggggtccagtagcaggcccagttttgataggattagccaacaaagacagtaaacaattataaaaatgttccctgtgctcaaagaaataacacaaaaatgtgactgagggctgggcgtggtggctcacacctgtaatcccagcactctgggaggccgaggcgggtggatcacgaggtcaggagatcaagaccatcctggctaacatggtgaaaccccgtctctactaaaaatacaaaaaattagccgggcgtggtggcgggcacctgtagtcccagctcctccagaggctgaggcaggagaattgcttggacccgggaggtggagcttgcagtgagccaagatcgtgccactgcactccagcctgggtgacagagcgagaccccgtctcaaaaaataagaaaacatgactgagaaatggaagatacagaaaagaagcaagttggacaaaatgtcactggaactaatctcccaagtagaagaattccacattgtttactgagatagttccccttcgaggaggtgatgcttaactcctcactccagaagcctgggctttacctagtgaccctcttccaaagagcagagcacagaagcaggaggagcagctttccagtggagacctccagcaacacagcctcaccagggaccatgctcaccatcagcagtgacatgcgtatcactgttgtgtactctttttttttttttttttttttttgagacggagtctcgctctgttgccaggctggagtgcagtggcacaatctcggctcactgcaacctccacctcccaggtccaagcaattctcctgcctcagcctcccacgaagctgggactacaggcacccgccacctcgcccggctaattttgttgtatttttagtagagatggggtttcaccgtgttagccaggatggtctcaatctcctgacctcgtgatccgcccaccttggcctcccaaagtgttgggcgcgtcagccaccgcgcccggcctgttgtgtactcttgataggatgatgagaacagcactctacctctttgatcttcctcccaaaaacatacgtaaccccagctaatgatgaaaaaacatcaaacaaatccaaattgagagacattccacaaactgtttgacgagtcctcaaaattgtcaaggttctcaaaaactaggcaagtctgaaaggtgccagagtcagtgggactgaagaagatgtgacaactggatggattttggatgatgtcctggagcagaggaaggattgggtaaaaagctaaggaatctgattagaatgtgsgtcctagttaacaatgtgtctaatgttcttgagacaactgtaccacacaaaggcaggatgttaatgatgggggacactggtgtagggcatgtattctaaagtaaaaaggtggttcttcagagtcaccggagcggtttaacaaaacattagaaacttcagaagaaaagattcctgaactaaaagcaatggaaactgtccacagtgatgtacagggagaaaaaggactgcaaaaacttagccgagcttcaaggacataatatcatgtggtctaacgtatttgaggttccagaaaacagtggggaagagaatacagaaatatgaccaaaaggctggacacggtggctcctgcccgaaatcccagcactytgggaggctgacatgggtggatcgcttgagcccaggagttcaagaccagcctgggcaacatagcaagaccctgtctctataaataatacaaaaattagccgggcgtggtagtgcctgcctgtggtcccaactactcgggaggctgaggcgggaggatcacctgagtgcaggaggtggaggctgcagtgagccatgatcgtaccactgcactccagcctgggcaacagagccctgtctcaaaaaaaaaattatggccaaaatttttcccaaatttttgaaaagctgtaagctcacaaatccaagaatatcagtcttaagcaggataaaaccaaaaccatatcaaggtacattatataatcaaagtgctggaacaggctggtgaagagaaaatcttaaaagctccagaagaggccgggcgtggtggctcacgcctgtaatcccagcactttgggaggccaaggcgggcggatcaccaggtcaggaggtcgagaccatcctggctaatacagtgaaaccccgtctctattgaaaatacaaaaattagccgggcgtggtggcgggtgcctgtagtcctagctactcgggaggctgaggcaggagaatggcgtgaacccgggaggcagagcttgcagtgagccgagatcgcaccactgcactccagcctgggcgacaaagcgagactccgtctcaaaaaaaataaaaagcatccagaagagccgtgcacggtggtggtgcctgtggtgccagctactcagaggctcgggtggmaggattgctcccagatggggcaacatagcttggccaacatggtgaaaccttgtctctactaaaaatacaaaaactagctgggcgtggtggcaggtgcctgtaatccccgctactcrggaggctgaggcgggagaatctctggaacccaggaggcagaggctgcagtgagccgaaactgcaccattgcactccagcctgggcgacacagcgagactccgtctccaaaaaaaaaaatttttttttgcaactcaggaagacaaccatttaaaaaaaataaaaggcaggccgggcgccgtggctcacgcctgtaatcccagcactttgggagaccgaggcaggcggatcacaaggtcaggaattcaaaagcagcctggccaatatggtgaaaccccgtctctactgaaaatacaaaaattagctgggcgtgatggcaggtgcctgtagtcccagctactcaggaggctgaggtgggagaatcgcatgaacccgggaggcagaggttgcagtgagctgagatcgcgccattgcactctagcctgggcagtggagcgagactccatctaaaaaaaaaagataataataataataaataaaacgcaagtggctgagcatggtagctgacacctgtaatcccaacactttgggaggccagcgcgggtagattgcttccactcaggagttcgagaccagcctgggcaacatagggagacccatctctacaaaaaaaaatgagcctgatgtggtggtgtgctcctgtgggcccagctacgcgggaggctgaggtgggaggatctcttgatcccaggaggtagaggttgcagtgagcccagatcgcgccactgcactccagcctgggtgacaaagcagactctgtctcgaaaaaacatacattgaaaaaggcagaagatttgaacagatacatcaaaaaaaagatagacaaatagcaaataagcacttgaacaggtgctcagcatcgttcgttgtcagaggaatgcacacgaaaaccgcagcgacagcgactagaacagccaggtgctgaggagggtgcggagcccctggaactcacccgtgctgctgagaacacaaatgctgcatccgctttggaaagcagcttgggagttgcatgtgaaattcagcatttaccacacggccagcagttctgctttggttattctactccagagtttccactgggggtcctttatgatttcgtctcttctatcatttttttggtatagatgggggtctcgctatttggattattgttgcaggcgtgtttggggtttttgagtagtggtagtgtctgaggtcagtcagggttgttctggccccagcagggctcttcgtagcttttcctgtgcaggtgaacaagcctgcggtttcacttgtttctcttaacttagaggagctgttgttcccaagagcagtcttgggctgaactttcaaataaaatgagtttcctcagggagcttcagagctctttccttatggacggcctctctccccaggctgatttctctgcaccacccttctgggcactgggtaagacagcagcctctgatcttcttggcctggctttcccagcatgggtgctctaccctactgttttaacctagaaagcctgaactgtatttaaaacttgtggtttttaaggccaggcacagtggctcatgcctgtaatcccagcaccttgggaagccaaggtgggtggatcacttatggtcaggagttcaagaccagcctgaccaacctggtgaaagcctgtctctactaaaaatataaaaataagccgggcgtggtggcacatgcctgtaataccagctacccaggaagctgaggcaggagaattgcttgaacccaggaggcggaggttgcagtgagccaagatggcaccactgcactccagcctgggcgacagcgagactccatataaaaaataaaaaaaaaaattgtggttttgaaaatgctttaattaggtgggagctgtggggagggtgatcagagacctgggtgtcctcagcctgctgtggcgggggtagtctcctctctgaggcttgggcaaggtggaggaagggagcccctggcttcttggccacgtgcaccaggatcttagtctcttcaacttggagtcggtgaggatgtgaaactctggtggtctgcccagcccatgagatccaggaaaccttatttgggaattgaggggagaagggtccccatcttcctgctcccctctccctgagtgtagtacccatcatggtgagctggggtgagagggaaagaggaggctgaggctcagatgccaccaggcttaatgttcgtaccaggtgtcagtagattttactccgtaagtgttcatctgttatatgcgtttaggacagttttgagactttaagtggtttaagctttgcttgtttcacaggaagtacttccatgaagttcctcacattgctgttccagaagtggaaatctctccattttcaaagcatagctttgccggatattgaatttttatgttttgtagagatggggtctcgctatgttgcccaggctggtctccaactcctgggctcaagggatcctcctgccttggcctcccaaagtgctgggattacaggcatgagtaactacacccggccaatatacaaagattgagtggcagggtcttttattttaatgcttttattttatttgttttggtttgtttttgtttctgtttttttggagatggagtctcgctctgtcacccaggctagagggcagtggcacgatctgtgctcactacaacttctacctcccgggttcaagcagttcttctgcctcagcctcccaagtagctgggattacaggcatgagccacgacactaaaatttttccatttttagtagaggcggggtttcaccatgctggccaggctggaactcctgacctcaaacgatccacacacctcagcctcccaaagtgttgggattacaggcatgagccaccacaccaggcattttaatccttttttttttttttttattgagacagagtctcactctgtcccccaggctggagtgcagtggggtgatctcggctcactgcaacctctgcctcctgggttcaagccattctcctgcctcagcctcccgagtagctgggacagcaggcgcccatcaccacgcccggctaattttgtttgtagtagagacggggtttcaccatattggccaggctggtcttgaactcctgacctcagataatccgcctgcttcggcctcccaaagtgctgggattacaggtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatggtctagatcttttgaccttgtgatccaaccaccttggcctcccaaagtgctgagattacaggcgtgagccactgcgcctggccggctcctccttcttattccttctgtctttttttctcctactggagcacctcaattgactgatcttcatgtttgctgactccttcttctcctagtcaggtctgctcttaagcccctctggttaatttttttttttttttttttttttttttttgagacggagtctcactctgtagcccaggctggagtgcaatggcgcgatctcggctcactgcaacctctgcctcccgggttcaaacaattctcctgcctcagcctcctgagtagccgggattacaggcatgagccaccacacctggctaattttgtatttttagtagagacggggtttctccatgttggtcaggttggtctccaactcctgacctcaggtgatccgcctgccttggcctcccaaactgctgggattacaggcgtgagccaccgcgcccggcccctctggttgacttttaatctgagttattatactcttcagctccataattttgatttcgtgcttctttacaatttttatctctttattgatactctctgataagatgtcattctcatactttagttcttcagatgtggtttcctttagttgtttgaacatatttgaaatgattgacttaaaatctttgcctcgtaagtccagtgtccaatgttttggcttctttggggacagtttctattgattgcctttttttttttttcccgtgtatggggtatgggtcctagcttcttgtttctttgcatatctctatttttttttttaactagagttttttgtttgtttgtttgtttgtttgtttttgagtctgttacccaggctggagcgcagtagttcaatcacagctcactgcagccttcacctccggagctcaagggatcctccctcctcagcctcctgagtagctgggatgataggtgtgcgccaccacgcccacttaatttttgtatttcttctagagacggggttttgccatgttgcccaggccagtctccaactcctgagcttgagcaacccacccgcctcggcttcccaaagtgctgggaccgcaggcgtgaaccagcgcagccggctggaaaactggaactctcatcggttgagagtggcagctctggagctcggactcccccacctccccaggatttgtcattgctgctgtttgtcgtggttatctgtcaggtagcttttcggcactaattctgtaaaggttgcgttctttcttgtttatggccactgccgtctctgttcagttaactgagataggtggtgatggggcagaaatgttcttgaatgcctggggccagtgagtctcccgtcttttccgggggctgtgtgtgtgtgtgtgtgtgttggggacgccttcagcacttggccaggcagtggacaacccaactgtatgcctgacttcctgcttacacagagcctcaaggtcagccagaagtgagagctcggggctggctcaggtctttcctgagcacgggcacggctcacacgtgtacacggctgcgagatgtcctggaatatctcagagcttttcagagcccctagtggcacctccttctccccagctgccaggcactgcctcaggcagccacagcgttcaaaaatcacctgtaaaggtttcaacaggcacacctcggcaaacagcttttttattcaggagagcttcaagtcaaatcagagacagccttgggagtggactcttaggtcagatgctgacagtcctctgggaatggggccctggaggagctcaagccctggcccaccccgcagcggctgccaggacgctgttcccacggggactgcagctgttggtttttaaggctgcagatggagtgggaatagggcatgtaaaatgccacaaagcctggctgggcacagaggctcacgcctgtaatcccagcactgcaggaggccaaggtgggcggattgattgaggtcaggaattcgagaccagtctgggcaacatggtgaaaccccatctctcctaaaaatacagaaatgagccgggcgtggtggcgcctatagtcagctactcgggaggctgaggcaggagaatcgcttgaactcgggaggctgaggcacgagaatcgcttgaactgggaggctgaggcacgagaatcgcttgaactgggatgcagaggctgcagtgagccatgttggtgctggtgcactccagcctgagcaagaccttgtctcagaaaaaaaaaaagttcacaaagcccactgttcttactaagattcagctgtttttcttgaataaatgctccccgtgctactgtaattctttggttaactttcagagttctggaaagttggcttggcgctttycgccgtctctctcctgctgccttggggtcctttccgtgaccgtttccctccctgacacgtgtacatccctgtgtatttcacatctctctatgctggaaagaggttctccacttctagtgccacaccacgggggtctttctggctttttccctgtttgcatctgcagctcccttccctggcagggagaaacctgccccactgcccttcaccagtttcttcactgagtcagccgccccttcctatgcagacacccctcacccctctctggccctgcttcaggccccccttccccgccgtgtgggcttctcgctgtcccctaagccttcgatgtcccctctgagccaccgcggccacggccaacagggatgcctccctcaccagcgcctcctgatagctctgggcctgagctcggtagagaaatggaagaggaaggtatatgcagtgtttgactgtctctgtttcttgtctcacgtcacaaaacaagactgaatttggatttctgaacgcgactgtgttttcctcgggagtaatgaaattagggctccatttccttcgctgttcccaagggaaaggtcctgcttaaacaggtgctttgtgagtggaaacgtggccagagtgcggcgggtgctttgtgagkggaaatgtggccagagtgcggcggatgctttgtgagtggaaacgtggccttctctggaagccctggggaggggctttccgactgagaggaaggcctcgcatctgcccaccgcccagtcctgggcctcacagtgaggatgcaggtcacgctgcacagatgaggccmgtgtggcaggtggtcccaggaacgaactcgcctcccgccagccccmtgggcctcccatggccccagccccatcaggtggaacgtgcactgcctgcgtttcagaaggggcggcctggggaaggggcggcttgggcacgctgcccctcaccaccacgcgtgacccacccatgtgtctccctttcagagcgggaacagcttccacgtgttcgaccagggccagtttgccaaggaggtgctgcccaagtacttcaagcacaacaacatggccagcttcgtgcggcagctcaacatgtgtgagtgctgcctccaggcagcgcaggggtgcgggaggcagacctgcagatggcgggaccccagcaggaggaccctgtgatgaaggacggggcgtcctgtgctggccaagggcatggcgtgggaccctgcaagcctgggggccggggagcagccgcctcttccatgggggagggtccttgtgggtatgaacctggggtccccatggaagaaccgtgaagccggagctgtactccacgtgtgtcgggcgcagggagccctgtggggacacagggtctcccttagaccaaggccactcggccacccaggcatgggctctgagggggcagggcagggtctgaccatggccaagccccgcagcagcctcctggagcagtggccgctcttcaggggttctggtcccgccctgaggcagagctgcccccttccctgttatgtgcagatggcttccggaaagtggtccacatcgagcagggcggcctggtcaagccagagagagacgacacggagttccagcacccatgcttcctgcgtggccaggagcagctccttgagaacatcaagaggaaagtgaccagtgtgagtgccggccctgcacccttgmccggtctcacctgccacagctctccccgcccgcccctccctgagggctcccaccccagcctgccccttcctgagggacctggctgcagtggacgagcctgagcctgccaagctcctaggctgctccagtgactcctgtccctctcgggaatccaggtgtccaccctgaagagtgaagacataaagatccgccaggacagcgtcaccaagctgctgacggacgtgcagctgatgaaggggaagcaggagtgcatggactccaagctcctggccatgaagcagtaggtcccacaccagcattatgggccacagcgggtcctggcgcccaccaagaggccccgggtgctgtgggggcagggccctgaccggggccaggtgctcagctccaccctcccgctccacgcacatctaccctgggcctctgccccagccccgccgcccgtggctgctgcaacagctctggggccagccgttttccatgtgcagaagggggttgggagggtcccctgctctgcacatccccagcgccctctgggccattggcttctgcctggctccgagcttggcgggacccaccagcctacttttgaggacaagccttgcacagcagacccgtcccacccgcctcgggcctggggtcagacccacctcaggcccttcctggaaccgctgtcccacactcgcctgggcccatggagctagcccccagcccctcctcaccgggaccctgcggctctggggaaaccttagcaggagcctaacacacggtggcacctgagaaactgaggcaagcccacctcggaaggccagctcaggtctcacgtccactttggggctccaggcatgcgggaaccccaatgccagtacggcttcctcggctccgtgcagcaggcgctcttgacccccacgtcatggaggaggccttggcctcagactctcctgcatggggtctagcaggagccaccggctttgtgattcctggagtccggccacgtggacctggcctaccaagaagactcacaggcttgacagggcccagcctcccagagcagcaggagcgcggtcatggccctgctcacctggctggggacagctcttccccacccctgagccacctccaggcctggcgagggccctgagcacctacaggacatgggacagccagtgtcgcagcctgaagaaccgtcctcccttaacctggctgctcaggccttggaagggcggcccaagggtctgctcctggcctgtgtccaaggcagccctccaggtgtttgccaggatggatgccaggatccgggtgcacctggctcgcatggatccatccccaacaccctacgtgacaccaggtgtccccggcagggaggggcagtgggaccagcaagccctggccctggcccccagtccctccacacacaagttctcatcctggggtgggccaggccagacatggtcacacttacccctgctcctgcatgggggacagggagggtctgtggggctccctcagccctggggctcatgggattgggccccactgacccagcctggtctgttgcagtgagaatgaggctctgtggcgggaggtggccagccttcggcagaagcatgcccagcaacagaaagtcgtcaacaaggtgggggcagggccagagggccggcgggggccccacaagggccggggtaactgtgtcctctctctccacagctcattcagttcctgatctcactggtgcagtcaaaccggatcctgggggtgaagagaaagatgtgaggttttggggatgcctgcatccaccacccggggcccagggctgtcccccttctctgtcagctgtgccccgggtaccccgaggtggggggtggtggctgacctgcacccttccccacagccccctgatgctgaacgacagtggctcagcacattccatgcccaagtatagccggcagttctccctggagcacgtccacggctcgggcccctactcggtgagtgccggagacagggcacccgcccaggcatgcaggcggcagtggggtgggttgcccctgccggcactgcatggacctcctgcctttgattgcaggccccctccccagcctacagcagctccagcctctacgcccctgatgctgtggccagctctggacccatcatctccgacatcaccgagctggctcctgccagccccatggcctcccccggcgggagcatagacgagaggtgggggccgcatcaccccagccatcctgtcccccaatgaggcgagcccctgtgggcccagggcagagttggggatgaggtggggctggccgagacgccagctcacctggcccccctcgtgtgcaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagtgagtgccgcccacccctggccccacccacagcgcctggacgcacagccctgggcttcagccccgactgtcccagtggactgagcagggcagctggcgaggcaggaccctacccccaacctcggggctcggggctggggagggagacaggtgccagccagatcaccccacagtcccaaacgccacagaagccacgggcatgtccggacaggctgccgggccctgctctcagccacccctcctgctgccgccaccctcgccacaggccacgggccctggcaggtcgtgctgcccagacacatggcaggagatggtgagcagggccggcctccacacccccagcccctgcctgcaatgggggctcttgtttttgtatcttgcagtttggctcgcactccacagatgtctagggtcgcccgcctcttcccctgcccctcttcctctccgcatggccaagtccagccagggttagcgctgaccccactggggagggaggagggctctgccagcgctcgggccctcccacacagccgtggaccagacccagcctggccgggcatgagcgtygggcctgggcggcagcagccgagacccctctgtggcgggggctcagtgtcgtcatggctcccctggccacgggcctgtggtcattgcctgtgacagggatgacagggacaggcctccctgctctggcacggcctctggtgttggcaggatccagactgcggtgctgactgcacttcctgtcaggcagggtctccagggcacctctgggacccagcctggctgtccgtcccatagcccaggtgtgccctgtggcctagggctttcttggtcacagccaccagaccgtgggtctcatccccacagcagcaccagggcagggactgagccacccacacactgagcagagccccacctgttttcccagtgcaacgggaaacctcaccaaccctgaacactgaaatccctgatccttgtgctggagctgaatacgccccttgtctcctgggtccactgccaccaaggcccccaggccctcatggcaaagggatgcccagcataggcccagccgcacccctgcagggcacagagcctccactgccttccaggccgtcctcgaatgcgctgccccctccagcctgtgcaggcgtacacgggggtgcagcctggggggtacagtcaaggggagcccttctcccacaggagggcattggggtgtggggcctggggcactggttcaggtaccgccttatcccgggccaggaatgagctcagtgaccacttggatgctatggactccaacctggataacctgcagaccatgctgagcagccacggcttcagcgtggacaccagtgccctgctggacgtgagtggagccccgccgccccgcckccccgccccgcctccccgcgcctccccgcctccccgcctcgcctcgccgcctccccgcctccccgcgccgcctccccgcctccccgcgccgcctccccgcctccccgcgccgcctccccgcctccccgcttccccgccccgcccccgggtgctgttctgacttccctccctcctccgcagctgttcagcccctcggtgaccgtgcccgacatgagcctgcctgaccttgacagcagcctggccagtgtgcgtaggcgggcggggggtgagggggaacgagaccagcgggagtgctcacaataccgtctccaccccacagatccaagagctcctgtctccccaggagccccccaggcctcccgaggcagagaacagcagcccggattcaggtgagccaagtcccaccggccccacctctgcccccaaccccccaccgccttgacacccccacccccgcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgctatggcctccatgtgtttcctctgtcccagggtggtgcggtgggtggtgctgcaatgaggaggggcccagggcacagaagggccrggctgcagtggcctcctgggggaagacggatgcttgcagctagctccgtgcctgcccgactccccaggaccagcatgtgcttgcagttctttattgagggaccaggggtgggcgcctcaccttggccctgggggtctctggttgtcacaggaccaccaggaacccccttcccaaggtgttcgcactcggacaggtgatgcggggcgggcacactgtctttctgccagagccagcaccctgtgtaggcacggggaacgggagcctgtcccgtagctttagggttctccactcagcctggtggaggaagggaagggggcytgcgctgggcagtggagcaggctttgctgctttatctggcagcaacagtttgttctcgagctccactggccaactgatagggagaggcacaggagcccatgtgggatggaggagtcggccccacacccatccccccaccaggagctcacccactactgccatcctcagcagggcccaaggagatgcctccatctcagggcccaccagcccccactggggtagagggaggataccaccaagggagcccaccctcccctcacaccaccagttcagcaggttgctgatgaggcccctggtgcagtcctgggaccctgtgcagggcctcctcaaacacctgccttgttgggccatagctgcaggtctggggacaccagggcctggtccagtcttggggtctttaatcaagcagtcaccccagcaaggtaaggcagcagcagggccctggggttacccctgacctcccgctaccatcaaggggggccccatctatccagcttggtggattgcagggcctgggaacaaggtgtcctgaaggctgcagggctgcgctgtctgcactgcccagcctggtgccagaagagcagagggcaaggcaggcctggggatcaggggtgccccaacctcgtggagggcagctgagagccaccagcccacctggctgcccaggttccaagtgaaggaaagaggctgccaaaccgagccctgccccaaggcgaatagccatggacatagccattgtgtaccgtagcccctcggctcaccagacccacaccagaaaggccctgtggactgcccatccctgggccatcctggctggagcccacttcccgcaaacccagggccgacctcttcccaagctgaagctgagcacggtgggtgcaagttgaccatcctgcactgagggccagagtgccgattcccgcacacccagcaggagtagcaccaggagaggacgcctgagctgagcttttctaggtaggggagtgtggggaatgggggcgtctgcctggccttgcactccccctaccggccatgcccgccctgctgcagtggagctgctgctccccggcaggtcctgggacagctgtccacacagctctggcactcgcccttgtgggtgtggccataccccccaccaggccccaggcccctggcaggctgaagaggtcactggacagcactttattgacaccctcggacccggggcagggtcagcaagactcccagctggcatcagactgtgtctggcctgctgtcgccatccctgaggggtgcaggacagagccccataggggcagagaggcctccctgggaccagaggaggatgctgtgcagccaggcccatccccagcactcgaggcctaggaggagaggtgggctctggcagcgggtgtgaggtggcagtgagaagccaggccctcaggtgcagctcaggcctctgccgctggggcctcatagttgagcacgtagtagtcgtggacgtacatgaggacggctattggctgtccgatgatgagcgacagccacacagctgcgttgccatagttgccctggaaaaagcggcccacgaaccaggccagtgggatctagggagtgaggggccaagtcagtcggccatggtgaccacagggctgggggcttcagggtccctgggcatggggagggtcagccgaggggttcaggtgcggggtaactgggcgagtgaggaggccacgtgggggtcactcacctgagccatcatgcccgtgaacgcccagaggcggaacattcgcagagggacgctcaccaggtactgagatgggagggagagaggatgccagggagtggggtgtcagccgtccctgctgtgggcatacccctgcccagggatgaggcaagatgccccccagagcactgacctcgtggaagaaggccgaggccaggaacacccctgtcctggccatccacttgctgctgccccgtcgaagcatgggcttgtagaagtgtctgcagaggagggggcatggaaagcggttcaggttcacagccatgttccacatcacacacacacacaccccacctacctgatgcaccacttgtgcacagggatsttccagttctgccagaagtaggtgacagactcggagttcctgggggccaagagaccacagggggatcagagcacaccatggcccatcccagcccccagggacaccccagggacactcaccaccagtcccggtagaactcccggtctccaaactgcatgagctcagccacggcattcaggcaggagtggaagagccagtagaagaagatgagccagatgaggtgattggggacctggcagggaggtgggggtgggcaccaagttctagaaccttcccccacatgccactgtcccctcctgtcctgtgcatgcgccacctgtccgcactcaccgccagcttcaggaggcgctcgatgatgcgtgagtagtccatgtcctgcagaaacaagcccttcagctagccatgctcctggtcactccccagccaccccagctgcaagagcacctgagccactcaccttgaagggcttcatggagttctggatggtggggaccatccactgcaaaggagggcaccacgtcagctcccagccatgcccagctacacccaaccctgccctaccccacttacctgctggatcagccccacctggagctgggtgaagaacagctgggggggaaacagagagcagccagctgaggccctggctagccagaaggccccctagcctccagtggctgcccccagcccccaacctcaccatctcaaggatccgtcgcagcagaaagcgcttccggatgcggggagagcggggaaagttgagctcgtagcacaaggtgggggcgaagaggaagtagtagagatctggaatgggaatggggggttggtaccagaacaggcccagcctgtcccccgcacctcaggcccacagaggtcctcaccgcggtaggtcagattgtccgggtagctcacggtgtgcggggcagcagcactgctggccttcttccctgcagaggctacgagcacagcagagtgggagggggctggtggggccctgctgctgcccagccccccagcaggcagccccagcccctggcagcccctcaccagccttggccctggccctgcggcaccatgagttgacgtcgcggtaggagaagagcttgaggaagaggatggtgtgcgccatcagcgccagcagggagcccactgcaggagaggtggactcaggcctccacagcgccacagccggaggccatgcccgtggctggcccgagacagatgggcagggtgggatgggggcgcacctggagtgatagactcaaccagtaagaccacagccgctgggaaacacagaatggtggccaggttggccacgtgcagcagcagtcccgcctgctccgtcagggcaccctggagtggggagcagagcactcaaccagggctcccattgcctgggagagggctgccaggcctggggagcagctcctcccaggagcgcacacagcagggtgagcacacacggaggtgaggggcactgcttaccaccgccaggcgcttctcaacctggaatgcagccacagcaaagacattggccgctgtggacagaagcaccaaggggcaggtttagggccacgtcagcctgatccccacccgaggccctcctcagagcccagctcaccaataaccaggcatggggcgggccagctatagggatccttcaggaacagagaaaccacctggatggggtccaccaggatgccatacctgggggtggagggatgggggtctgagtgggtggcaggtggggctgtggggcggggcctggacaggccatgggtggggcaggggtgggacctggcaaaggcactcacttgatgaggttctccagaaataaccgggcattgctcaagatctgcgagggatggacaggagggtgcagcccctttagtcctggccacagggtactcaccccagatcctcccaacacctctgggcacgtcccagcccgagctcagggcggcagcctcaggcttgcagacccagccctgtctggtctccatgccaagctctgagactcagcacccacctcagccaacaccagtgctgggtaaggggaagtccctccctgtccccatcacaccagacggtcccacatggagggaaccaaccggccagaccaaccaaccctgccagacgcctgggtcttcaggagcagaaagaccagctgctgatctgctcacatccctcctgctgagccgagccagtgagggacccaaggctcccacagccaaccacaccccagagacagccccagaatacaggcctgcccagggaggcctgcccacggctgagccccaaggaaccagtccctactggtggccaaggctgaagagggggagttgtctactctttctctgcaggagcagtgtccagctgtgtcgcaaggggggctgggcctggagtgcttcccagggcttgtgccccgcctgcctcttctgcttcctgccgccctctaagccttggacacttggctccaaagcaacttcccaggactgagcccccatggaataaggctcttgggacgagcctggagttgggtgcttggcctccctctgcaaggacaggaacctcctcctccatcttacaagcactaccaacacctccattaagctgggccccaatgccgcagacctggctgaccacccggagctcgggcctcatgcggtagtgaactggtgctggggaaaagggtcgctggcaagggaacactgagggtgtcttgcctgggtggtcagggaaggcttcatgagagagaagactgcttcagagacacaagggctactgccccgcctcccccggccgcagggctgacacacaggccttctgcatggacacgtggcccacactgtcactggcctctcccgagggctgacagcaggcagaagccaaagctgccaatggacggtacccacctccaggcccaggccacagaaggaatgcaacaagcagcccagagcgggatacatgcctggggtgggggcatgggggagccaaagcagggaaaaggcttcagggctgggccaaagggccaggcaggcccaaggggttggggagaatacacagtgctgcctgggctggacaaggcccaacctgggccaggaatgggctgcgtctcctgagtgctgggctggcgctgggcccactgtcctcctgcctggccagcttctcagccaccaggactcgtgggcctccacagctggccacccccagggaaccttctaggaccatgggcggtgggggatgtggatgtgcgtggagccccttccacgtgggtagccacaggagcagcacccaaggccagagatagacacgcctgggtgaaggtcaaaggcctcgagccacatcagccctgagttggggaggctgggcccagatagcccttgtccccgacctgccctgcaggtgcccctttgagccctagactccaactacttctggggtnnnnnnnnnnnnnnnnnnnnccaggaggactgcagagtggtggccaggcctgcagggctccatacccacagaggccatgtggcgtagcacaggaagctcttctcacatcccctgccagagaggccttgtgtccacagagcatgcagtccactctcccaccagcccagggcaagaccccctccaccctgccctccctggaggccctgcacccctcaggcccagctcacaacacacaggctccagccaggcactgttcggcctccccacgcccacaccacatctgcaggactctcctgggatccaatgggaagcagcaagtatgtggtgcatgggcacccaagtgaccacagcaggggcagccactgccactcccctccccaacagtccagtgctggcagccacatggaggtgcagcctgctccacacaccccagcccacaggggctccagcctggacaccctgggtgacagagcctgttctcaggcaaaggccagcctgggacagagccccacctggacctagacccgctcccgacaccatgtcccactcaccagcatcaccacacaccagttcaggatgccacggtagttgctgaagccactgtcagagctgaataaagaatcctgcaggcgatggcacctgacagagcacaacacaagcaccccctgagtgggcaccagcagggcagcgccacccccgcaggatccaggcccccaccccagtgtcctcgtctgccctcaggccccactccttatttacaaccaggaggagaagccaggcagagccacactgtggcctcaagacctacagtgggcaaagctctccggacccccagagcctgcacctccaggcagcgggacga

SEQ ID NO: 17704 - DNA, 16622 bp, Homo sapiens
cagaaggataagggtgtgtgatatggcagcaagtgatggttctatcaaaaacaacatgtatgaaaacactgcataaaagaggactcagcgggtcgggcacggtggctcatgcctgtaatcccagcactttgggaggccgaggtgggcagatcacgaggtcaggagatcaagaccatcctggctaacatggtgaaaccccatctctactaaaaatacaaaaaattagctggacgtggtggcgggcgcctgtagtcccagctactcgggaggctgaggcaggagaatggcgtgaaccaaggagacggaggttgcagtgagccgagatcgtgccactgcactccagactgggcgacagagcgagactctatctcaaaaaaaaaaaaaaaaaaaaaaaaaagaggactcagcaaatgagaaaagaggatgtgatcaggaaagatgttgttactgggtatgtgctaaggccttgaagatcaataaatttggaccctggggtcatcagtgtcctccataaggaaggacagagtgaatctctgtcctgaatctactgtcctgaatggacagtaacaattacggagaaatgaggcaacttgaaatccctgatagggaaatgggagatgacgtttcatagcaaatttaccaggctctttcatgccttgtactttgttcatgacatccctcctccctccttttcctactgccaaaatttgaatccttgaagattacagatccaagcctacagttacgaaaaagaagtagctataaggaaggaaaagccttttcctctatcctcttaagttcagtggctgaggcctgtaaattaaactggcaaaagacaaattaacaggagaaaagggtttattcatatgcacagggaaccacaaaagaagtagctggctcatcaaatggttgaaattagccaggcgtagtggctcacgcctgtaatcccagctactcggaaggctgaggcaggagaatcgcttcaacccaggaggcagaggttgcggtgagctgagatcacgccattgccctccaacctgaacaagagtgaaactctgtctcaaaaaaaaggaaggaaggaaggaaggaaggaaggaaggaaggaaggaaggaaggaaggaaggaaggaaaaggcttacacatctaacttagtaggagaaagggaaaggggagaaagttccaggggagaaagaggtttcttaaggaaagacaaaagggttttcaaaagaacaaacatgaggccagaaagtgtgtgatgctgtggtctatgccagcatgtgtggtcttcctgtcttcttcagagccattaaacttccctgaaaagggtatttatgttgagtttactcttggtctccctcctcagagtggaagccttgctgaagagggtatgtatggcagtcttcatttctgataaaagaaaaatagctcagagcactctgaactatgtgaggtacgcaaaatgtatcaggcccagagagacatgagtatgggacttcagtcatacactccacccctcacccccacccttgctcccacaaaaccaagaagtggggtgcaattgtttgttcctagtcagacatgcctcaccctttatcttcacattcctgggatttatgatacaaagaacaaggcatagccaatcaatagcttatgttatttttatgtaaattcttggtgaacaacttagtgtctatgaaaagagtgaaactctgtaaaatatttgaagagatttattttgagccaaacgagtgaccatggcccgtgacacagccctcaggaggtcctgagaacatgtgcccaaggtggtcagggtgcagcttggttttatacattttagggatgtatgagacatcaatcaaataaatttgagaaatacattggtttggtcaagaaaggtgggacaatctgaagctgggggatggggagcttccaggctatagggaaatttaaacattttctggttgacaattggttgagtttgtctaaagacctgggatcaatagaaaggaaatgttcaggttaagataaaagattgtggaggccgggcacagtggctcacacctgtaatcccagcactttgggaggctaaggcaggcggatcacgaggtcaagagatggagaccatcctggccaacatcgtgaagccccatctctattaaaaatatgaaaattagctgggtgtggtggcagatgcctgtagtcccagctgctcggggggctggggtaggagaattgcttgaacccgggaggcggaggttgcagtgagccgagattacactgttgcactccagcctgggcgacagagtgagacgccatttttaaaaaaaaaaaaaagattgtggagaccaaggttctttgaagtctcttagtggctgcccttagagacaacagtcgacaaatgtttcctattcagacctttaaaaggtgctagactctcagttaatctcttcaggattggagggcccagaagaaaaagatctgtgttattagagattctttacagatgtaaattttcccccataaggtacgactttgcagggccatttcaaaatatggcaaagtggccgggtgcggtggcttactcctgtaatcccagtactttgggaggccaaggcaggcggatcacctgaggtcagaagttcgagaccagcctggccagcatggcaaaaccccatctttattaacaatacaaaaattagctgggcatggtggtggtgggtgcctgtaatcccagctactcgggaggctgaggcaggagaatcccttgaatctgggtgggggaggttgcagtaagccaagatcaccccattgcactccagcccgggcaataagagtgaaactctgtcccgccccccaccccaaaccaaaaaacatatatatatatatatatatatatatatatatatatatatatatggcaaagaaacatgttttggggtaaaatattttgactttcttctttatcacgtaattttatgccagagtatgactgaaaaggcagtcacaatatatagtgttaaataaaacccaactgataagaatttatggtttgtagggcatgactccccagaccctttcgataggaatttgagcaagataagaaaaaatcagagcttagtcctcattaggaactgcctcttcttctcctttaaaaacccacttgtgacttctgctaattgggagcatatactcagggcaacttgaatcttcgcttcacagtcttcaaacttggcccaaataaactctctacttatatcaagtttgccttagatttttccctttaggttgacatttcccagaagttttaatcagatgaagaaagctcccagaaggtttatttctgcatctattgaatctgaaatgtcttcggcttaaaataattgttataccaactctggtgttctgaatgggtccccacacagcaaagaatagagccagaatgttgcatttgtgaaaggaaaataaaaactcaggactccagttgactatgccaaaaggaaaaaaaataaactgaaaactgagtcatgcaagaagctgcctttccttttgttcctaagcagatagctacagacaaaaggttaaatatttacaaaattagccgggtgtggtggcacatgcctgtaatcccagctactcagtaggctgaggcaggagaatcacttgaacccgggaggcagaggttgtggtgagccgagattgcgccattgcactccagcctggtcaacaacagcgaaaactctgtctcaaaaaaaaaaaaacaaaaaaaacacaaaaggttaaatatctccacaggcatatttactttatcttatgtaaagtgccagacgaacacataattgagtatctccctacctgctccttttctcttgcgacatgtggattaccatacccttcttctttccctccagctcacttttcccctttaaatattgaagccctcaaaatcatctttggagaaagccacagaccacagactgtttctgcgattccgtgtttatttcttccagccatgtccttaaccttggcaaaataaacctctaaattgattgagacctgtctcagacatgttttgcttgacacatccaaattccagttccagcacttactagctagctgtgggatcttgagccacttacttaatcctactttccttctccgtaaaatggggataattataataccgacttccaaatttgttgtgaggattaacttaaggcagagtcctcagaaaagtacctacagagggttattcgggccaagggccaaggttgaggactgcgacccaggacacacttgcaagttgtcttgggggagcactctggacaacaaaagagaggctcatattttcaaagaaaaaaagatgaattaggagaggaaatgaatacaaaagttgttcatcaggaattctcattgtttacagaaataacactggttatacattgtttagcgcttggctatacattgttgaactataaggtgtatggcatttaatggctacttggcatagcaagtggtttcaagagataattacttagctcaaagaagagtgagagtgactgttgctacattttaaatgcctgtctgggcctgataatttaaaggggctcatcttccttagataaaaaggttttgttttgttttgtttttcatagtacataatcttaaaaatgcatgctaattattactgtgagtactctatctgagatgatgtccccagaactggggggaaaaaacacttgtaaaaaattatcaaaggaaagaactgacaggacttgatagctctgaggattcctcagaagcactcgtcaaacagcttagggtttaattgctattctgccacttaacttctttgtgcctcatcctatctgtaaaggagggtaataatagtatttgcagggaccaagggaaactttcccttcgccctctgaaattctgctgaaaaatcaacccacaaaaaacagattaattgaagaaaaggcatagaaattgtattaatgtgtccacggggaaccacagagtgactacccacttcccagacgagttcagaagcttaggtgtcattcaggcaaagggggttgtgggagtgaggggaagaggaattctgctgagggagaaggaatggatcagggaacagattaactagcacattatcatgtgaaggggtctgttcaggtgtgattatattcttggttttgtagggaggggaagaaaaaaaccgttgttccttttgatgggtctggacgctaggtaacggctttgggagagagggcgcgggagtaggaaggccagacacaccttaaggcttaacttagtaagtcaaaccaccatattttgggtatggatttctgagccccaatataataggtacttcttagggttgttgtgagaattgaagattattaattataaagtgcctgggttggtgcttggcacatcataaacaactccataaatgctcgcttttactgtcgtggatacacggaggtgggagacccaattgggttcccgcccatgttattggcccccacggctatatggtctttacggcttcctagtctcttcaccatctctaaggtttgtttcctcatctgaatcacaggtgagtgattctcagggtgactcaagagggctggtgccagtggcagagcatggggaatcgagggaaggcgccttcctgtcagaggcaacacacccagtgggaggatcctgcccgccctgctctctcctacctccccttcccgggctaaacgctggggtcggtctggcagctattccgggaatctgagcgcggattctgacaaaggagacgtcttccaccgaccacatcacatggagctccaaagcacgagcacggcctcccgcggctgtgacctcaaggcggagcccctggtgacctcagggagagtccccacccccgcagcccgtgcgcccggggcagggcgggggcagggagagggggcggaatcggggcggcccagcggacccccacgcaaccccagcctacgcagcgttgacagccgcccgccaccgagagatcagctgtcagagatcagaggaagaggaaggggcggagctgctttgcggccggccgcggagcagtcagccgactacagagaagggtaatcgggtgtccccggcgccgcccggggccctgagggctggctagggtccaggccgsgggggacgggacagacgaaccagccccgtgtaggaagcgcgacaatgccccgctacggagcgtcactccgccagagctgccccaggtccggccgggagcagggayaagacgggaccgccggagcccccggactcctttggatgggcctggyyctggcgctggcgctggcgctggcgctggcgctggctctgtctgactctcgggttctctgggctccggcagaggctcaccctctttctccccaaggccatcctgccaggttacatcgcatagtgccccggctccgagatgtctttgggtgggggaacctcacctgcccaatctgcaaaggtctattcaccgccatcaacctcgggctgaaggtgagcactgaaggggctgcagtggaggaggccgaaaggagtgctggggctgggggctggggctgatgctggtgcgctgggctcagaatgcatccctgatggagagggtggcatctacaatccatcactgagtttgctcccctttggggacacccatggctacatgccaccatcaccccattgtgacctttgtgaagtaagaaaataatgcagacagtgcctgaggaagtcagcttgccaagcaaaggcctcatgccacaggccgctgagctaaagaagaagcgatggcctggtgctgcctgagttacagggcaatatctggaaggcaaaggtgtgcactgagcttggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccaccyctttgaggatgacatggtggaggtgtggagacgctcagtgctgagcccatctgaggccygtggcctgctcctgggctccacctgtgggcactgggacattttctcatcttgraacatctctttgcctactgtgccgaagccgccccccaaaccccctagccccccagccccaggtscccctgtcagcygcatcctcttcctcactgacctgcactgggatcatgactacctggagggcacggaccctgactgtgcagacccamtgtgctgcygccggggttctgrcctgccgcccgcrtcccrgccaggtgccrgatactggrgcgaatacmgmaagtgtgacctgcccctgaggaccctgkagagcctgtwgagtgggctgggcccagcyggcccttttgatatggtgtactggacaggagacatccccgcacatgatgtctggcaccagactcrtcaggacmaactgcrggccctgaccaccrtcacagcacytgtgaggaagttcctggggccagtgccagtgtaccctgctgtgggtaacyatgaaagcayasctgtcaatagcttccctccccscttcattgagggcaaccactcctcccgctggcyctatgaagcgatggccaaggcttgggagccctggctgcctgccgaagmcctgcgcaccctcaggtacttatcgtccgtggaaacccaggaagggaaaagaaaggtgaatgaaagtgaagggagaagggaacctggggcattgtctctgattgctctagcatgagtccttagtgctcttcatttggctcccctaatctgactcctccttccctttctactgttttgccgcaccaggctttttttttttttttttttttagtttagtttttgtagagacaagatcttgctatgttgcccaggctggtctcaaacacctaacctcaagcaatcctcccgcctcggcctcccaaaatgctgggaccacaggcatcagctactgctcctggccctcccttttttttttttttttttttttttttttttgagatggaatcttgctctgttgcccaggctggagtgcagtggcaccatctcagctcactacagcctccacctcctgggttcaagcaattctgcctcagcctcccaagtacctgggactacaggtgcacgccaccacacccagctaatttttgtatttttagtagagatggggtttcaccatgttggccaagatggtcttgatctcctgacctcatgatctgcccacctcggcctcccaaagtgctgggattacaggcatgaaccactgcacccagctttccagccctccctttctactcttatctccagccaccctccttcaaaggtctggcagcataacctctctatgccccagctgtgtctttgctcatgttggccctctggaaatgatttcccccttttttttaagtgctccagtttttcccaccttatccatcccatgtcatcttccctctgtgtggtccttgcttcccattctagctaactcttatccctcccccatactcctggagccctctgccctcagagtcttttgtgtcacacagacccaataattagaactgtttggtctctggctagactgtgagctccttgcaggtggggaagatgtcatgtatgcttttaccctccacccaaatgcccagcacaggaggaccaggattggaacaagtgttgacctctcatgtttactttgtttcagaattggggggttctatgctctttccccataccccggtctccdcctcatcyctctcaatatrartttttgttcccgtgagamcttckggctcttgatcaactccacggatcccgcaggacagctccagtggctggtgggggarcttcaggctgytgaggatcgaggagacaaagtgagggccagtagtgggaacacggtggtgctgggggacaagcaggctcctgttgagctggagcacctctgggcacagaagttttattttcctggcattcccaacaagtgttccctggggattcagctcatggtcactgttgaaarccttcattcagtccccctttctctagccagggctgcctggacccctggatgccctgattaccatccttaattctccctactaggtgyatataattggccacattcccccagggcactgtctgaagagctggagctggaattattacygaattgtagccaggtaggacggagatgagggtgggaatagggacagggtgagtgtctgaaggctgaaaattcccttgagcatctcaccatccctgttgtcccatggagtggggaggctcctcactagaacaggttggagaaagagggcatcctatctccccagatgtcttcctacccctccctagaatcttctgaatgtagtaccttctggccaggtrtgagaacaccctggctgytcagttctttggccacactcatgtggatgaatytgaggtcttctatgatgaagagactctgagcyggcygctggctgtagccttmctggcacccagtgcaactaccwacatcggccttaatcctrgtgagtgaggcagaagggagcctcccttatcctggagttggtgggataggggaaggaggttggagccagagcctgcaaagcatgggcaggatgtgtggcccctccctggagttacccttgytccttgcccctccagtcagccccacatccttgcaggttacyktgtgtaccaaatagatggaaactactccrggagctctcacgtggtcctggaccakgwgacctacatcctgaatctgacccaggcaaacataccggsagccataccgcacyggcagcttctcyacagggctcgagaaacctatgggctgcccaacacacygcctaccgcctggcacaacctggtatatcgcatgcggggcgacatgcaacttttcyagaccttctggtttctctaccataasrgccacccaccctcrgagccctgtggcaygccctgccgtctggctactctttgtgcccagctctctgcccvtgctgacagccctgctctgtgccgccacctgatgccagatgggagcctcccagaggcccagagcctgtggccaaggccactgttttgctagggccccagggcccacatttgggaaagttcttgatgtwggaaaggrtgaaaaagcccaaatgctgctgtggttcmaccaggcaagatcatccggtgaaagaaccagtccctgggccccaaggatrccggggaaacaggaccttctcctttcctggagctggtttagctggatatgggagggggtttggctgcctgtgcccaggagctagactgccttgaggctgctgtcctttcacagccatggagtagaggcctaagttgacactgccctgggcagacaagacaggagctgtcgccccaggcctgtgctgcccagccaggaaccctgtactgctgctgcgacctgatgctgccagtctgttaaaataaagataagagacttggactccagacccctgtgtgactgtcccaatttcttctttccaggcaagcagggcaaggagatctttggagcaagatcataactgaggcacaggctaatgggttgatggtgtggtacaggcataagaaggcacacagcagtgcagacagactttattagtgatatcaatacagcagaggtgcccatggagcagggggaagggacccatgcctggaccagtcccttcctccttctgcccctgctgggtccaggaggatgaggcctggcctggaccagttcctcctgttccacctgaaacacatggggatggagaaccagggctggccttgcttcctgctcctcttgttaccactccagtgttatcacttccttgaagggattagatctctccctccccagctcctaggcagggaaccgtasctactggggaggggcatatytgggaggcctgaggcctaggaatagcctctagacccctccctgacccacaccctttagttccctggggcccaacacaakcaggtggagggaaggtgggggcttcttcatggggtatgggcccccagccgtttgggcttcagggagccccacagcgactgaacacccctgcggacagtccaccctacacgccgtgccacagactcagcagggggtgctgggaggcaggaggtggaggcctgggaacgggcatccagacacttctggtagcgaagctgcggaggcaagcagggcagtcactctccagcctacctcccatggggccacgccaccaccacaccaccctactagtagcttaccatgcacgcagcctgcacagcctctgagaggctggcagcattgggctcgcaccagaacatgtggcagcagaaggaggctgggccggcagccatgatgaatgcaaacgtgtggacatctctgcccacggccaggaaggagaggaaacgcacccgacactctcccagcactgcctctgtctgcatggagggaactcagttaaaaaggaacaccaaccccacactgtgttccacatccatcttagcagctcttcccctcacccccagtctcccctctatggcaaggcgcagccacgacttctaccccagctctttacctgctggtgcaagatggtgagggtagcaggggccacactgacatgacttggggtccattgttcacggctgctggaggacaggactgactcgagggccccattaatcacatctacccctagaacatatggacacaagataccactgagggtagacagaggataccccagctctaccctggacctctagttccacccaatcaaacccagggcctttgccccatccccactttgccagcctacattttggacaacgctgtccaagtatcccttccctggggctctcctcccctggcttcagtaactggacattttcctactttttaaaatcttggatcctaggctcgttattttcaccggctctgcctattcctccacacttctgaactgactgacctctcaaagttctgatttccccaaatcatgctctctcagcgctcatcacactcagacatcacattgcttcacaccacaataactcccaaatcagaccctacaggccagtcctctcccaagacccaattattttttaagatatctatctgaggagtgattactctgtatcacattgtgctaagtcattacagtgtattacctcatttgtgcccacacaacaacatcacaatagattactttatttccattttacaaataaggaaacggaagagataggtaatatgccttaggtcacatcgaggaatggggacctgagctcaggcagtctgattccagagcctgggttcttagccatgcctttctcctacctcttctctatattactagttttcagaactagaagggctttcaagatcttagttctactcaagaatgtctataatgtgctcaagagccaaggaacccaaggttcctgactttcagatcaatcaactttcccttataacacatggcctcctccacctcaaactgctgttaaacatttcccctcatggatcccacttttgcttgcactcagcagagcaccaaggcaggagcacatgttgtggcaaaggcatcagttctagtccccacactcatacgctggctgtgtgatctactgtctctgcacaatgccagtgcaaaaggcacatgcctctgtggtccactcccaggccctctgccccttttagtggctctcagctcccactaggagcagaccacgtggactcttttgggcagaggacaaatgtcttccttgcatgtcttctcccatcttggccttgctcatctgacttctagctggatcaaggccaaactgctcccaaaagcatacaagtcttccaaaaactggcctcaccagagctgtcaagcttcatattttactgctccctgagcttcagatgatttgtgtagcattattattaacaactaatcttggcaaatggcctgtaaagcagatggggaatacaaagcaagagaagagaatgcccttgagagacacagactgcaactgagggaaaagcctctgtcttgagtgccctttccctgctggactgagaaacttcagactgtcatccttcagggctccaactaggtgctgtctaggaagccatgcctgctgcagggcagggagaggacaactctgagacaactcttaccataacgtcttgtaactgctggaaaacttttttccacactgggccgtggccatctcaagaacagaaatggaatttaattcatccctctgtccccaattctaacacagggcttatctgctgaagaaattccagatgcatgagcaagtcactctcaaggcaacaagggcaaatgcacccgaactggtaaaaccaagtgtcacagaagtggatgggccaggtcagattgcagagtgcttcaaaagccaggcagaggggtgtgatgtttatgacatttaggccagggcaattggaaatctcaaagttcaggtgtgtgaaagggacatcatagtcaaactgctgaatagatggggctgtgggagatggagcctggcctcagagtcttgggaagtttggcagggaagcagtgaaagcagtggaccaaggtatggaaaaaggctgtcagatttgataactcaggactaaaacctacactgtgaccttgacctccagccccacatgcaatccccctaatcctgctgtgcttttctcttcttttttttttgtatcagttgttgccttctaacatactccatggtttactcattttattgtctgtctctccttgctagaatgtcagctaaataaaagcagggatctttgtcagttttgttgattaatgcatgccaagaagctagaatagtgcctgacatgtatcaggcattcattaccacttgttaaataaatgaataattaatgaatgaatattgcagcttctggatgggctaatgtttaaaaacgagcataagataaagcaggaagtaagtttagagaccacttgtccaagcggagcagtcaagggtcacaggcagttgatctggcatagggaggaccagagtcaagtggtagatggaaagaagcacatatgggaatgggggtaacaaatggaagagccaacaagggtttagaagttgaggacgagaaggaggaaagcaaaggcgtaagggtcagcatgcttttctcacctccagctccaagtctttggcagtgccatcgaatccaaatgaaatacccactccactctgcaaatccaaaccttctttcaaaacctcagttcaatccccaccttttctaagaagggtcccctctttcaatgtaagattttggacgtgaaagtcagcacggtataagggaaagtgcagagaattaaagatgaccggggtttgactcccaggtctagctttcctggccatgtaatctgaagcaagtctcatttattcattaattcattttttatttcattcatcaaacatttgttgagttcttcctgtgtgtcttttgacatgataccctaccacttctttttcaagtagcctcttttcttcttcctgcctctctccagttgtcactatccttggcagtttcatcctctacacatccattgaatgttggagggcctcaaggctatgactagcttcatttcccttctcacttcaggatgcccactttccagggccaagctactctacatccatggctttgattacctctacaacccaataatgccaaaactcctatctccagcccagacctctcctctcagctccagatctgtgaatctaactgccaacctgactttgcctctcagattccccaaaggcatctcaaactcagcatgtccaaaagtgagctcacaatctctacgctcaaattggcctcttcaagcatctgccaccttgaaagaaataatccactatccagaaggtccaacagccaggaacttaggagtcatccttgtccctcacccacatcgaaccaatcactgaggcctgttgactatacccgtctaaacagctcttgaatccacgcactcttcttcagctccattgttgcccaagatactctcattactggccaggactacagcaagagcctcctaactgagctgctcacatccacctccacccacttaacagtcccctccatgaaatagccaaagtgagctttcaaaattcaaatctgattaaggcaagtgcactctcggagacttcaataactccttgctgcccttaggatgaagaaaaaatcattaacatagcccctgaggtccctgacctggcagcctgaccactgcccagctgtcggcctcatcttgcattggccttctttcagtaccttggaaatgccaaagtgcctcccactgtagaccctgatcttcccccatcccacccccacctccattccacttgaccgcattcacttctacttattttttggatttcagttcaaatgtcactttcacagggaagtcttttacaacctcagactagatgaaattcctttgttatatcttgctactttctctcaacgaataactcacacatttatttgtgtgattattttattaattcctggtttttttctaccataaccttctataacctctaggaaaatgggactgtggccactgttctccctgtgcctagtccagggcctgccacatggtaagcttcaaaggtatttgttaagtgaataaacaaataaatagcagacactaggaaagcactgaaatataagagttaaccagatcaggccaggcacagtggctcacgcctgtaatcccggcactctcagaggccgaggcaggtggatcacttgaggtcaggagttcaagaccagccctggccaacacagtgaaaccccgtctccactaaacatacaaaaattaaccaggcgtggtggcgggagcctgtaatcccagctattcaggaggctaaggcaggagaattgcttgaacccaggaggcggaggttgcagtgagctaagatcacgccaccgcactccagcctggcggacagagcgagacttgtctttaaaaaaaaaaaaaaaaaaaattctttgcaacaatgaagtatgtgacaattatgctcactgtttccttctccagatgctcccagcccacagctggtgctgtaacactaaacccagctacaggctgctgtctggtgtcctccagtcatctaacatcagcctcccaatcccaccaaagcttttccatgggatgaaggagtggggtctccctttgtgcctggttcagcaccactcacgtggctgatgctcagcgaaggcgtgctgactgctgctataggcaggacaggaaatagagctaggacagaagtatggggaggtgggatgcattttaaagggtagggagacaccaagcatgaggaaggtctggtagaagaagtattggaaggcagagggtaggggcagagttttaggatcaaggtagcagcccctgggtatagaaggacacacataccaacaggt

SEQ ID NO: 17705 - DNA, 16589 bp, Homo sapiens
aaatgtagaaggaaagggaaaaagaaaagtcatcactaggcaaataccacaataaaaatcatttcagacaagagtcactgatgaagctaatattagtaggcacaaatctgagaaaaaatttatataatctcaaactatctttcccaatatattaactaaaaagggaaagatagtaattttatcatggaagaacctgacagaaaccatcttaaccaagtggtcagggtcaacatcaccaataagaaggcatgtacctcatgaaccctgtgacctgatgcagtgagaaggccccaacttcatctctgtgaaaatgtagaacctcagtgcaattaggagaaaacaccaaggggaccaaactgaggaacatttgacagcataactcatcagtattcctggaaaatgtaagcgttatgaaagacaagactgaggaaccattcagactgcaggagaccaaagagaattaactcaatgcactgtgagatcctgggttgatcttgaaactgaaaaaggatgtgaatggaaacactggtgagattagaataggatccagtttacttaataaatccatgctcatttttctgtttttgatcattgcactatgattatgtaatgtgttaccattgggagaagctgggtaagtggaggggatatggaaactgtctgtactatttttgtatcttttccgtaaatataacgttaattcaaatttttttaaaaaaagaaaaaaggtaaattgagtcatgtcactcctctgctcaaaacctccagtggctccctatgtcactcatcatgaaatcctcagtcctctcaatggcttacaagtctccatatgctctggacatacttctctgacagtatcttctcccatgcctcccctcactccttctggctttccttgctaattctcagcacagtgggcattttcctgctttggtgctactatggtttgagtgtatgtttccctccaaaattcatacattggaacttaatccccaaggtgatgctattaagaagtggggcacttaaaaggtgattaggccatggaggaatgggattcatgacctcataaaagggcttgagggagaaagttcttccctttggctcttctaccacatgaggacacagcaagaaggcaccatcttgggagcagagagcagccctcaccagacacgaattctgctggagccttgatcttggatttcccaacctccagaactgtaagcaataaatttttattatttataaattactcagtcttaggtgttctgttacagcagcatgaacaaaataagaaaagggcctttgcacttacttgtgccttcagcttggaaatttcttcccccaaatatctgcatggccacttcctctcatccttcaggtctctgctcaaataacaccttctcagtgatgccttacgtcaccatcccatatataatagtgtactcactcattctacctgccctcttttttttccctctccactgtacttttcacggtctaacatactatatatcatgtgtttgttcattatctctacccactagaatgtatctctaagagggcagagactgtgctgttttgtttagcacctacacagtaagcactcaataaacatttacttaatgaatgtatgaacttatcattgttatgggaattatttgtaattatttgtcttccggggcttggcgcagaaatgtattagattaagtaataggccaggtgcagtggctgatgcctgtgattccagcacactgggaggccaagataagaggatcacttgagcacaggagttcaagaccaacctgggcaacaggataaggttgttgctactatggtttgagtggttatgaagtgggagtttatgttcattccattgtttttacttggaatttatatttttaatgcagagaatttataaaagagacaagcaataaaaggcaaacatttatcttgcacctctttgatctggtattagtaaaaccgtggtaagtctaaaggtttaaccctatctctacaaaaaaaaattaaaaatcagccaatgtgtgtgggcatgatggtgccctgtagtcccagctacgcaggaagctgaggtgggaggatcacttgaacccaggggtttgagactgcagtgagccgtgtttgcaccattgctcctcagcctgggtgtcagagtgagaccccatctcaaaaaaaatactaataagtaaataaaatatgtcagccaggcacagtggctcacacctgtaatcctagcacttcaggagtccaaggcaggcaaattgcttgagcccaagagtatgagaccagcctgggcaacatggtgaaacctggtctctacaaaaaatacaaaaattagccaggtgtggtggctcacctgtagtctcagctactcaggaggctgaggtgggaggattgcttgtgcctgagaggcagaggttgcagtgagccaagatggtgccactgcactccaacgtaggtgacagagcaaggctctgtctcaaaaaaaaaaaaaagaaaaagaaaaaaagttatttcccttttattttaggaataaggtacttaccctgtacatatccacatactagcatgacagataccaaaatattacaatgattattatctctggatgctgggactatggggctttttatttttttgcatatctgtactttacacaataacattttgtgtaatctttttttaaatgcagaatactgacattggagaatgctcttcatatattttaagtgaaaaaggagtaaaaactatataatgtattatctcatttttctaacaaaatgtaaatgtgcatagcaaagatacagaggtgttatagtgccagggaaaaggggtgcaagactagtgtttgcctcttatttcttgtcttgtttataaattctctacattaaaaatataaattccaaatgaaaacaatggaataaacacaaactcccactttataaccaactaaaatgacagtaactgaattttctaaagttttaaacccaccaaaatgggagaaatggatgacagcaccagcgtttgaaaggtggaaagtggagggacggtgggcagactacttggctgacccaagaaaactgaatcctaggccagctgagacctatgttgatttacagaatcccaagaatgctcaggaactgggagaagaccaaggacatcagaagagaagggggtgaaaataaggaaagttgttgaaactcagtttaagaaacagttagatatccatttttgttcatcaaagtcgagtgactctcctgcagcagggttttctccggataggatatctggaccaagaaacactagacacagtagagggcggtcgaaatatgctgaaatcaggaacagtcaacagatgctgaggcccccaccccagccctctctccacccttgctgctggaatgctggagacagggagaatcttttctgcgcgagctgacctgcctgccaaaaaaacgacaaagaaactgccacaggaggttccccaagtgaaaacagtcagccacctgccctataggaaacagccccctcccacacaattaccctcagagatccctgttttaacatgtgcaggcaatccaggattacctaacgtgcaaggaaagcctataagatggaaaaaaaattttttttgaggcagggtctggctctgtcacccaggctggagtgaagtggtgtgatcacaactcactgcagcttcgactcctgagctcaagtgatgctcccacacagcctcccaagtagctgggatcacaggtatgcacaaccatgcctggctaagttttttttatgttttgtagaagtaaagtctccctatgtttcccaggctggtgtcaaactcctgggctcaagcgatcggccccccaaagtgctggaattacaggggtgagccaccgcgcccagttcaaaacaattttttaaagaaaacttgcagaaaataaagattatgtatgaaaaaggaaacttagaagatatcaatgaaacaagaacatagtgctgttagcgtgcatgtgcacatgcgcacacacacacaaagaatcaaataccctcaggaagataaagctatgagaatatcccagagaagagaaattttttaaatggaaaatagaataaaaagaaaattaaaggacaagtccaagaggtatatagtcaaaaaaaatggcagttccaataagagagaacaaagaagaaaagtcataaaatgtcccaatctaagtgtgaatacaaaaatatattatttttatagtaagtgagaaaaacagggtgcaaaaggtgtatatgatgccacttcacatgtagggacaagggaaaataagaccatatattcacagttgcttgtatttacataaactaataggataccaaaaaaaaaaaaaaacaacacctaagaaaaatagttacttgtgagggaaggtggagattccactgaattttttacatacacagttgacccttgaacagcaggttctgaactgcacagatccacttatccacggattctctcctgcctctgccacccctgagatgacaagaccgacccctcctcttcttcctcctcggcctgctcaacgtgaagacagtgacgctgaagacctttgtgatgttccacctccacttaatgaataggaaatatattttttcctccttccttgtgattttcttaacaaccttttttttttttttttttttttttaagacggagtctcacactgtcgcccaggcttaagtgcagtggcgcgatttcggctcactgcaagctccgcctcccgggttcacgccattctcctgcctcagcctcctgggtagctgggactacaggcgcccaccaccacgcccggctaatttttttgtatttttagtagagacggggtttcaccgtgttagccaggatggtctcaatctcctgacctcgtgatccgcccatctcggcctcccaaagtgctgggattacaggcgtgagccaccgcgcccggcctataaacaacctttaaaagacagtaagggacacagcagggcagtaagtgcctcactcacaagaggagcagcaatgccagaggcccatagagcacggattcccagcgctgccgttttacataatcagccttcttgatttttaaaattatctgcattcgtaactttcctaaaaataaaaatctaaaaaattaaatcctttcacttacaaaaacaactctctcaggccttactcctcctgactgggcatcatgtctttgccaacggagacccagagtccagagaaacccgaaaaagcaaccccagctttcccaggatgagctggtcgggaggaagggaggtcccaatcccagcgcttcggggccagagcaaagcgaagaggctccccatggccataagcgggcggcccacgcagcgcattgcaggcaggtgcgagccacatgcgccaagtgcccggagcggccctttggtagttagtgttaattaaaattacccgcacgggagtggatccccgctgacaatctagaaacaagcaacagaccctctgatgtagccatctgtgccgcgcctctccgcaccgcccgccacgccttggtccctggagaccaccctccagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggcccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccatcacggagaccctgtgggagatgccgtgggccctctactacagattaggaaacaggcccgtagmggggtcacacggccaagtagcggcactccaggcactgggggccctcgaggggaaggggcagacttctgggagtcagagccagcagctgggctgggaagcttcgagtgtggacagagagggtgggaatgacgttccctgtgggaagagagggtgggcaagcctgggatgcctctgagcgggaatccagcatgccttgtgrggagggtcacaagcacacccttgtgaggaggttgagccccatcgaggacaggacggagggagcctgagcaggcagagagggggcctggggaggcgctggttcggggaggaagtgggtaggggagaaatcttgacatcaacacccaacaggcaaatgccgtggcctctgcwgtgggggtttctggaggacttctaggaaaaygagggaagagcaggaaaaggcgacatggctgcaggggccaagcccaggagccgccctccacagcactcattctgcagaagggaaatttgaggcccccagacrgcaggggttgatcctgcagagactggtgagcaaaggggatcaccccaagccccagtggcactaggaacacttacaatctctgacctggactaaggctgccagcctggcccagttaagagtttcccagaaggatggcccatacactttaaattaaaggggccagacacgtgcacactacttccagccactctggaagctgaggtggggggatcrcttgagtctgggagttggaggccagcctaggcaggcaacatagtgagaccccatctccaaaaaaacaaaacaaaacaaaacraaaaaacaccaaaaaagctcccagaaagacctctgaatctttctggatctctcagtggagacctggaartctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggyagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtmaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactayctgctctcctggcctggccttgtctgccactgccagctcctactcagccattcctgaacagaggacagcagagaagggccagcaccctcccagaaccatgtggcatttgccaactggattttgaccataacaatgcagccattctccccagcaccatmataggcccgcccttacaggaggattcsttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtycatgctcctaactgcagtgttccctcaccatcagaaggcagggcatttaatacaccagatccccaccgcctcccatctgatttgtcttgstcaacagtggcccaggccactcctacttcactcgtccccaccctggcccttcccgcaggcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagyactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgmagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatcyatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcragtcgtcccggcctctggygttctactcaygtgctgacctctttgtcctgcagcagttttccagcttgcatgtccgagacaccaaaatcgaggtggcccagtttgtaaaggacctgctcttacatttaaagaaactttttcgcgagggacrgttcaactgaaacttcgaaagcatcattatttgcagagacaggaccygactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctrgcacttggagccaagggttcagagactcagggccccagcactaaagcagtggacmccaggagtccctggtaataagtactgtgtacagaattctgctacctcactggggtcctggggcctcggagcctcatccgaggcagggtcaggagagsggcagaacagccgctcctgtctgccagccagcagccagctctcagccaacgagtaatttattgtttttcctygtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggccagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagctacttcctcactggggtcctggggcctcagagcctcatctgaggtaaaggagcaaagttgggattggggtccaaaattcactttaactccaaagcccacacacttaaccaccctgcctatttctgtccaaatgtcacctgtcctgaatggagtttttccccctgtacaactgtcatcaacctgttcgggccctctcactgacaggcaggtccctacctatatttgaggggcagcccattgcatttctggacagctctcgccattagggtgcacacacgcaccacctctgtgaacagggctctggctaggccactcctcagcagctcttgttgcttccccatggccctggtcagcagctggagtgcagagaccagcgggccttaccaagccacagctccaggccatgcccgtcagcaacacttttcactgtgactctctgggaggtgcccagggcagagggtgactccaggatgggatgcctttgcagtgggtgatggtcttcaagaaccagtctcaaacttgtagtgacaggcaggtgccctccctggggagcccagagccctatgggaacaccacagtgatgctcagaagtccctgaaggcagccgccctcgactgctcatggctgtgtcattcacgcaacagcagaggacgtggcagggagttcgccagggggctgatgatggtggccagctactccagaaccactcactttccccagggagaggcgacggaagaaggcaaacctgacagtgcagggggcaggggacacttggcctagaggagagaagactgtgggggtgaagagggtgatggtgcaagagctgggtctccagcaggctgtcccgggcaggagacaggaccggctctctggtgccaagcctattaagtcctgccacgtttgctgaggaaatacctgcgggggaccaccccacagcagacacctgggctagtgacaaccaagacaccacatgcactcaagatttagcccctgaaagaactctgtagaaacaacagagggtcgggttgggggagctgtatgtcctccctcgggagggcctcccctctggaggtgagcagtggctgcttccgcaaaggacgagagagtcttggaagccaggggaggtgggtgggagtcagggtctcggcattcttctccatccagagcctagggtttaaggctggaaggatatttacggagggtaatgactttgtaaacaagacctagaaatctatctcccagtagcatcatctttgacccatgtcctctctgcccagccaaagtattgccctgcctatccagaaagatggaaacccttccagtgaaattccacgtgactccctcaagaacaaagactggaattgaggctgatgtggggcaaggttcctcgggatcctccaaggccgtgctctgagccacacattcaggacagcctgcgaggcaggtgcacagtgcggatggcygtcccgggccccactaggggtctgcagctcgccacttcctcagccaccgccgagctcctgtccctcacaccttccaggctgctccccaggaagggggacctgtggtcactggcagtgtgccctgggctggagagggcgtggggctctccagggatgagtgacaccttactgagccacagaaccgagctgcagctggtggcgacagggaaggggccctgtcaggaatgagaaaggaagacagaacaaggtaggtaagtgtcagcactgcaactgtggctgggaacctccctccctggggactgagccctggtggtgtttgctgggagttttctctaaccacgtggcctaagttctttcataaacaaggcaagccctcagcaggactcagagagaagggggttgagaagggagaagagtgcttggtgagtgggaggaagatgctggccatggggcccagggcggggagccccttggcacctcgggaaccccagcccaggaggtttcactggaagagaggctgggcttgagtgagaagtgagacacacgcgagtttccggtgaactcggcaccaaacacctcagtttgctgctcagatgaggtgtcagaaaatgctcccagtcacttggcaggtttctccgaggctggccccctgtcctgcgcaggacgagaaggagcaggccccaaggggacyaggcccgcatcttatttccttgtgaccgaggcagcagcttgaagcctggccttcacctggcccagcggcttatcgctttttcattagggtcaaagagaaatgtcttctgcctatgcccttcatctagctggtgcattgtaacacactccaaacctgtttcccacttcgcctgcctcccttctaagaaggtccggctggggccaggctgactatgttccagacaggacagcctggccagggacacactggccagctcctatctggcctttctaggggtccaagctggggtcaggactggtggctgtctcctcagctaccctcccccacactcataaagccccattatcttcattcatttctcagctccacccaaaagcaagagggcaagggtttgcaacaaactttcccagatcaactgatttctcggcagcaagggagggccccatgacaaagccatttgaaatcccagaagcaattttctacttacgacctcactttctgttgctgtctctcccttcccctctgctataccttttcttggggaaagtgattctctcacagcgtcgttcagaaacacccccagccatgtgctgcctgcctgggcagacgctgctgtgtggtcagaggtgacgcaggcaccaaaattaaatatagcaactctcgtcagctccactctctgcatcactgtggacaactgtgcgggggctggacaccatttccccaaaccctcaagggaggaaggcccaagccaccgatggcatcccctgtagacccacagcccgatggcctgttggccacacagtccacaactccctgcccagcccagggccctgtgccagaggagctgtggtgatgccacattggaaaaggcaatttttatttactcttctttcttctgatctgtttcccacattttctataatgagcatgcattcattttccaatgggagacaaggataaatttcatttttaaaaagcaaaaagaacatgaacgtgatgtctgctccatggaggatgtggaccgagacaggccagtgaggagacctggttgcagcatcccccggctggaccagcaccagcacccctcagaccagcctaagtcctccctggggagccggccctctcgggagaggaggtgggggtctgcaggggcctgcaaggcagcccctcagccagacaggactagcaccgctcctcccatgggttgggcactcttggacccatcagatcccacattgccaaagacagaggaaggtgctgccttcttgggggtcttcactaggccctggcctgccagggcacaggagccagcgggagtgggaagggaaagggtaggccgcccatctagctctgaggctgaagtgacattaacactatggggacagatggagcattcctgcagactcctcagcagctctgcctctcttgggagaaggaccttccacctgcttctgaaaggcaagagaagccaacagcctgcagagctacttccccacagctccgcaaagcggagtctatgccactgcctgccagcctcgtttctctcctcccctcggtccctgtgcccttggatggggccctccatgtgtctgtgctctgggccccatcccctcccctctcaggaacacaggcagagcatatagccgggggctcagggtgaaactagtcccagcttcaagccycagctgtgtccctgacttctagtgttgttacttcagccacgtctcagtggctccgtggaaatggagctccactcattcattcaacaagtatggattgaggccttgcctgggtgccagaccctgctctaggtgctgggggtccactaaacaaaacaaggttgcttctagcagggagacagaataagccaacgagagaacactcagtgtgtcgggcggtggtagccgctaccgtgggaaatagaacagtccggggctgcacagcagggagagtgctgtgttatgcgaggaggttggagaaatcctccccatgagataagatgggaacagagatcgggacgaaacaaggggaggggacamccatgcacagatcggggcaaagtcatcaagggaaagggaactgcaggtgctaaggtcttgagcaagagcgagctggggatgcccttcccagcactcacgggtggccctcgggctggagcagaggccasggcaagggcagcaggagcccagcagggcctcagaggccaggaccgggcttcattctaagtggaatggagtgatgtggtctgactcacattttaacaaagtcaccgtggctgctgtgtggagaacgcaacgcagggcgaaggcggagcagggagatgagcgccaaggtgcctgcagagatgctggtggggagcgatggtgcttgtggtagtggaggactggagaggggcgtgtgtgtaagatgcatgtatacattatactgctatcgtatacattatttacttaaatagtatattatataatccataaagtatagatataaatatataatatataaatgtgcatatatgttaatatttacatttgctatgcaattacaattttaaaatcttctattacagaaaatttcaaatatacacgaaagtcactcccaagcatccattgcccagcgtcaacaatgagcaactcatggccagttttgtcaattttgttccatctctacccccgccccttccccaccaccaccaatccgagatgtcacatcagtgaaaggagaggctttggggtggcttggatatgagcgtgtgaggtcttcccgtgttgtgtgtgaacaactgcaaggatgaagctgccgctcgctgagctggggcagcctgtgcttgattgtgtcccattcagaacacagctgacaacctacgacgcagcctgcagcccaacacagctgccctcccagatgcccatactgagttccacctcatctggccacttcctgtgcccccaactgcactcagatatctcatgaggtcactgattatcaactccactccgtgcagcaacgcatgtctgcccttatctagcctcacctacgaggaacattgctgccgctgaccactgctcctcctccctgggcctctctcatgcctggactctgcaccctgcctcaccaccttccagtgtcgcaggagtgccctggctcatttcttgtcccctgtcttctctcaccccttggccatattgttaggtcaacaggagtggaggagagccagggtgacaccattttaaaatcaactccatcttaaaactagctaggcatattccttgccagtcactacccatggtcatgagatgtttacgccaaggaagcagtttagtcacgcccgcaaggacaaactcctacaacagcagaatgtctgggtgtcctgatgtctcataacaatatatgctttcaagctatttacagtaatgctttgatg

SEQ ID NO: 17706 - DNA, 41396 bp, Homo sapiens
  misc_feature (1)...(41396): n = A,T,C or G, or insertion/deletion polymorphism (see Tables 1-2)
ccagccgtaagctggcgcttcagccctcatggactctctacaccctaaggaacgagccctgagatctgggttttgatcctggccccatcactttatctctgtgtgcctctttattgtgtcagtcagctactggtttgcttgcaggtctgtgggatggaggtgggatgggaggagtgaagcagccaggctatttctctcctctctgctttctggcttcacctgcagttggttgtcttccttccttccccacttccataatcccatctcctaccagtagtccacactatttagttcctgccaaatggctctggaggcttcttggtctttgatgctacatcaccctgccatctttccaggcctagagatggtagctgcttcccgctctgctgttttctgagctgcctcccattgtcttctcagctcctccatcacccatgtaccagttagttctctgtgttaaacttcttctgtttgaaagacttagagtgtttcttgtttcccagctggatcacgaaagacaaatcttaccaataaatggctactataatgcccagccatccccaggaggataaagggagactccaggggtgagaaatccacaggttcaccgcgggcagggcattgtctttactcctgtccttttgtgtttttcaccagagcctcctgagactgatttccactgggcaacaccagacccagaccgagcaccccaggacgcctagaaggtgtgtgagggtgggactcttctcccaggccttcttccgaaggagctgctgagagagccttctttccacaggcccattaggcatccagaaagggggctgatggaaatggattcttcttcttcttcttcttcttttttttttttttttgagacagagtctcagtctgtcgcccaggctggagtgcaatggtgcaatctcagctcactgcaacctccgcctcccaggttcaagtgattttcctggcctcagcctcccaagttgagtagctgggactacaggcatgcgccaacaggcccggctaatttttgtatttttagtagagatggtgttttgccatgttggccacaggctggttttgaattcctggtctcaagtcatttcgcccaccttagcctcccaaagtactgggattacaggcacgagccactgtacccggccaggaatggattcttctaaatactttttctttctctcttcttctccactctgctcttagctgactagtgctcttggaaatggtctggcaaacacccagaagtgcataacagatgagggttgtccttttccagagtatttgcattttcagtggtgacaatgccttaacccagtcttttcaacgggggtgactttgccccccagaagtcatttggcaatatttggagatgttttggtcacaatgactcaggaggtgctactagcatctaatagatggaagccagggatgctgctgaacatcctgcacaggattgtagataggacagaatcatcctgtcccaccacaaagaatgatacagccgaaaatgtcaatagtgccaaggttgataaaccctgtcttcaatcaaagtgataaacttctagtagtgaacttctttttttgtttttttttttgttttttttttttttgagacagagtcttgctttgtctcccaggctggagtgcagtggcacgatcttggctcactccaagctccacctccccggttttatgccattctcctgcctcagcctcccgagtagctgggactacaggcgtgcaccacttatgcccagctaattttttttgtaattttagtagagacggggtttcaccatgttagccaggatggcctcgatcccctgacctcatgatccacccgcctcggcctcccaaagtgctgggattacaggcgtgagccaccatgcccggccaacttctagtagtgaacttctaagtaaactgccaggggactagatgaagagtggcatttttctggtccatcattttaaatgaaagagaaatctgtaccacataagggcagctgaaaggactgttgtcttccacagtgggcagcccccagtgtgaagtggctaattagctccaagtagtaagaataaagagttgcatttaactaagtaactgattcttatcctggaaaggatagaagtgaacagggaaaagtgaagaaaatttagataaattaatagaccacaaataaatgggttgtcagaggaagttaggatgtttgaagttttgcagatgctttttcgtagcatatcccgctctgtcaaagataaactaggaaagacgccagttctgctgtcttctgcagactgggtcagcaaacagtgaccgctagacactgaggtcaccaagatgaatacgcctggtctctgtccttgtgttgcgggaagtcagggaccccaaacggatgtatacgtacaaacacacatacatcaggataatagtaaataataataataaataatagtaaacagtggtaagtgcagagataggctctccctaggagggtggagtgattacttccgtcatctcctgtccgcggagaacaagaggcaggaagaccctttgcactcataaccctcatcccatggcagcccctctggtttcacttctctccctgcagccgtgcatattttatggccacaccacagggttagaggatagctggtgttgggaggggaaggcagccctgggttggcgggaagggctggggctctgggggagtctgggggtagtcctgggaaggcagggggtccttccaagacagagtctacaaagctcttgacttcttatagaacaaaactgtacttctctcaaagtcagagaaggagaactgggcttggaaaggagtggcctggttttcagtctgaccccacccctaactcctgggtgactgtggccaagtcactttgcttctgtgggcctcagtcccctcatgcatgaagcagggggctagatgcaaggtcagctggaaaaagtctttgtgcccatctgggttgccttacccaccccttcttgccctttcattttctcaggtaagatcaccggggcccatagaggtcaagtgcctttctcaaagtcacatagtttaaaagcaaaaataggggctgagtatggtggctcacacttgtaatcccagcactttgggaggctgaggcaggaggactgcttgagcctaggagttggaggctgcagtgagccatgatcatgctgctgtactccagcctagaggatagtgcatgatcctgtctctaagataaataagaaaataaaagcaaaaatggaagttgtagaaacatacctatagcatggtctctgtcataaaaaaagaactatatattttgttttttaaaaatacatgtaagtttataaaggcacacaaaaagatatagacagatatacaaattatggtggctcccctttggggagggaaaggaaggggactaagggaagctctatatacttctgtattgctgaaaaattgtactgtgacaaaaacatatttgtgtattatttgtacactttaaaagatcatctttaaaatggacttctgaccaaagtccaggtctcagatttctattttcctcacaacaccaagcctgttctagcccgctccaggtctagaatgctgcagcactaggctcgcattgccactcccatacccggcaggacgtggcagggtcaccaccctttggctcagcccagaccaggcattgcaattcttctcacagagcccttgatatgaaaactatttgccatgctgccttaagctagtggttggatttcaggcatgagctggcaaatagaaaaggcagggaggtgcttttcagaacctttgagatcaaacagccagggtgctgagcaccttattgcagggaggaccatgcccaatgtaaggacctggctcaagggagactggagtttctaggggtctctgggatatgtggggcagtggggacagtgcagagaccttttcacagagccaaggagataacccagcacccagagagcagacgaatccacgggctctgtgtgggagtgagggaggccttcccggctttcacatccaggtgcacctgagccccgatcccccatgagtctgtctcaggaagtaaatggcaaaagcgctaagtagatagccccagaggaggaggagaattctgaattctgtttatagctctgctcctattttgttttctaacctcagaaaactgatttatccttgggaagggtcagtttcttcattaggacaatgaagaaaaatccagctgtcccttccaaggggaggtatcatgagcagtatcaaggtaagcaagggaacctggtttggaatcctggttgacaccggctttcactttaagaagtcgcaagagactgccgcaagagaggaagccacagaccaggttggaccctgagcctggagtactgccttttctcttctttgcctgctaaactccttgcttgtcaagattcagcagagatgacaccttctctgggaaggcttcctgagtctcctgcagtgagcccctaggctcccctagcccttggctcttatgtcttatctctgagaaatctgagatctgcacttttgttagaagtccgttttaaagacaatcttttaaagtgtacaaatagaaaccttatcttattgtattgcaggcctatctcctcccccggtgtgtatcaatgctcaggctgggcctttgtctgctggcttgtggagggaggcaggacaagccagtgaccacattcctgcactctgggctgcctcctgtggggcccgtgaggaagcggcagccttccctgccgcgtgcagggcctgggttgtgtgggtggctctcccgagtctcctccagccctttttgggtctgattctctgaccctcctctctctccttgctcaccacttggcactccactccttatccttttgctgcattaagtttggaaagagattttggagaaaatatagcccatcaacgaatttctcctcctcccagggcctgtctaggcgtgtgccatgcccaccctcttcctttccagcgctggccacatcctccctgcaccttcagtgcctgctttccctgcctcttcctgggctccgggtctgtgtccasagtgtcctgcgtggccctcgcgctgcctctggtygcccacattcctgcaactctgtgaccacagcaggggcgattacacattcctggcctggcagccaacagtgtaaaaaagaacagaatgtcctagggccccgcctagcccccagcttcacctgggcccctcccgggtctggacaaggttggagggggtggcgaggaatcagcaggaaagaggagggaccaggaggaggcagacgcatcccacctgagtgcgctgctcccacttagtgagcggggaggagacctgcagagacctcttctctcttctctgcagggcctgagggtgaggctgacctgtgggtgcccttggagggctgcccacttgctgagcctctagctcctggaagcacacttgggactccccccttgctctccttcctggagacagactccctttggtgctggctccttctatttgcccccaccactgccccccacctgcctctactcactcagtgcccctcctccatccctatctctctgtccttcgctgtccctctctattgtctccctctttctgccctcctgtcctcccggttccccacccaggccctctcagcctggctggccccttctccttgtgttgccctcctagctgtgggctcaggatccttctacttgttcagatctttgcccctcacctgccatcctgtcccccagcctccttgcctgtctgcgtctaaagcccctgcccagagtccgccttctcaggtccagtactcccagttcacctgccctcgggagccctccttccttcggaaaactcccggctctgactcctcctcagcccctcccccygccctgctcacctttaattgagatgctaatgagattcctgtcgcttccatccctggccggccrgcgggcgggctccccagccaggccgctgcacctgtcaggtgasggggaggagaggtttggctgccagattcaactggaaaggaaccagtcycagtccagccgcaacctgggagtgggaagctggaggcagcccagacctcctggagccctgcagtcctggggcagagacagaatcaggacacagctcgaggtcagggccagaggctggagctgagggcctagagtgagagggggcaaggcaagrkgggragaggaagagaggcaggattagagagaggaggcaggccagaaagaggagagcaggagagacccaaagagaaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggacccyagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtcggttagtccctctgccccttccctggtgcctgcgcctggaagggtggtccagggtgctgaggtgctcgctgggcaggcagagcctcagacctgagggtgggaactgacacccctgtcccaggtagagctcactgctggcaaaatgaggagcctccagcttactggactggcgtccctgcccagtggagccatcctagcaccccaggctcacccagagtgtggttgttggagcagcattgccctcccctgccctctcttctccttccctcccattcccttctccctcctgcaagtgggagggagtgcttgcaaaagggcaggggtgtgctcagctgcatcccttttctggagcaagatgccagcaaagtataagacctcgtccacctcagcaggagagtctgatggaggggtgaggctaggtgaggggaggcgagaccgtgcaggtgctgtggaggtggtgctgtcagtctttgtttagaaggggaatttattatggagaaagcaaagagggggatcgtggaggttagggctgcaagtgagcccaaaggctgggggcaggggccttacagaacaaggagaatgggtcaggctagagagcagctccttgtgaagctcttcccccaaaagacccaggctaaaatgctgcactgttgacctgcccaggtgcctgacctttacgtgcttgggtgtgtcctgaacttttgggtttcatcggtgctctttgccaatgttgggtctggaaacyggagcaggtggtaagcgtggagaagagaggagggcagggctgagtgcttttgtataccttttatttgtattcactcagccatgccacaccttgggaacacctgcttcaagccagacacagggctaggcacctggcaaaatggattcatgaataattcataagccctttattgaaggccaggtagtttgctgtgttgtggagacagataaaataagatagcagagacaggcatataagccagtaactgtggcacactgggataagtatgataaaaatggtgagttagtgtaccttcaaggagtgcaaaatctttatgggtgtgggtgtgagtgtgtgtgtgcacatattggtatgtgtgcgattttggatgctggggattggtcatgctgtgggtggaggccccttcgtatattccatcatgtccaaaggtgcgttacggactaagaaagggtgggacgtcctgtcctggagagagagagaaaaaaaaaagccaggtcatttcgttgattaacgtctgtataatgtcccaggtagggaccatttccttaggaagctgccgtgtgcacagacgctgcgaaggtgtcttgggtatctcatttcattctcacatcttacaagcccggtgctattgttatccctattttacacttgaggaaactaaggcaaagagaggcaagtcacaacatcacagagagagtgactgagctgtgactcatcctgtttacgcctaatcccaaaactctgcctctttttaatacccaagatgtggggctttgagtgaatgaaacttccagtcagatgtggcttccgcctcatttcagagctctcttgggtccttcctcttagcctcatttttctccccctgctgcctgcagacatcttcacccctttaggccttggtggaggggagggacccagcaggaaggggaaggacagcaggcggggcagtgggcactcaataaatatttgtggttgaaaatatgtcagtgagagatggaaagggagggcaggggtgaatcgggtgaggcctgcacagttcttaggttctgctggatgcggggccctagacagtccaggaaaaagccggggaaaggaagccataagccctgcctctggggcctgcaggctgggaggcagccatctgcccagaaagaatccctccttcttgaagggctgctgtgggagtcgggagggagagaacacctaggagaggagaggagtcggggaagggctccccagcacagcgggaggagatgcaacacccaccaagcactacacacttgaccttgtagtcacattatgtgctacaccctaaagctgggtgctttatagacactctctcatttaatactgacaagtccagggaggtgggcagtattattcccatttttttagatgaggaaattaaggcttggcaagaggaaataatttgagcaagggaacatacattatttatttattaaattaaaaaataaccgctgggcatggtgcctcacgcctgtaatcccagcactttgggaggccaaggcaggcattgagggatctgggatggagctcaaacaaggttgtttaaaagagcccctcacttgaggccaggagttcgagaccagcctggccatcatggtgaaacccccgtctctactaaaaatacaaaaatcagccaggtgtggtggcgcacgcctgtagtcccagctacttgggaggctgaggcaggagaatcacctcaggaggccgaggctgcagtgagccgagatcacgccactgcattccagcctgagccacagagtgagacacagtctcaaaggaaaaaaaaacartaataatgtttgtatatatttatgggccagactttttacaaatgaatctaaatcaaatgattctgctttaaattatttaattctcacaacacaccttggaagtaggtctcatgatgactcttattttatggatgaggaaactgagtcccagagagttaagtaactgcctcaacttcagacagacaacaagtggtgaaactgggactcaaaaatcatcccccgccccccgccccacccccacccccaccgtccaccctcacccccaccccccgcccccccgccacgctccaatggaaagccagggcatctcaggttagcagctgagtcacaaacctagtgtgtttgatttcaaagctcttttacccattacactttaagtagggatcaggcaaagacctcccagggtcgggggcagctggtgggagcccagcgggcagagcagcagtcattggaggacaatttgtcaggcgtgcaggagggagggatccagggccactcctactcaggagagtggcagggaggtaaacaggttaatgagcccctgtgagtgaatcaccgggagcgcagtgaatgactcctaccgaggagatcggttgatgagctagaggaactggagtgaggcagagctgcccagggctgcctacctgctgagggtcgccaccagcagagggagaggaggaaagtggacatgcaggactctgtgctgctttctaacttcaaggaaaggggacaaagcactgaagacctttcagactaagcaaggaagtgctgagtccgaagggaagggttggccactgcagcccctttctctctggtcaacaaagggcttcttcactgaaaggagagggccagtcatacctacagtcatggaaaacagagcccacagacatatttttcatccagtcccaggaacggtttaggctggacccaagaacttggggttcttgaacaatgaaggaggtcatggtagcttctttcctggaaatggcacagcaggaggccaggagtgggtgaagcaaggggcagtttcccagagagagctcctgtggggaggatgggaaagccctgagctagggaggccgtccctgcctgtggtccccagacgtggcgggcagaccctgcattccctgggcagtctggacaccaggctgtgctcagyagggctggcaggaaaaaaagcctggactgttgagagttgacatccctctaaccctgccatggtggttggatccttctcatcccaggtgggatggggcctaggcggctcccacggctgttaggatgagcatgggctcttctgtgagaggaggccaccggggtaagagggagggaagaggaggagagagcagagtgtcagcctccaagtctcccagggtccttgcaccctgctgctccgtcctggacacggaagaggggctagaggggagagggccagctgcagggaaaggagattttgctgcctgatcccagatgcttcagagctgggaggcagacacagtggaaaaagcaggggccgtggagtgaacaggcctgggttcacatcttggctccagtccttcctggctgagtgaccctggggaatttgcctagttgataggcctcagtttcctcaactgtaaaatggggataataatgcctgcccgatggaattgtgtaagggttgactcaccctccaatgtagggctgcctgccagagcagatgggagtgagggcagtgagcatgacctgaggaggaggtcaaggccagaagggctggactgtctggaagaacccactgtgggcattctttatcccttccctccagccgctggtctcctcaaaacaagatcggatgtcttcaatgtgctttctgtttagtggtcaattctcttagctctaggtgtcaactcaaaggctctgcctcctgctataggaatttctagtatcacggggtcatggagggagagattttttttttttttttttttttgagacagagtcttgcactgttgcccaggctggagtgcagtggtgggatcttggctcactgcaagctccgcctcccgggttcatgccattctcctgcctcagcctccagagtagctgggactacaggcgcccaccaccatgcccggctaatttatcatacttttttagtagagacggggtttcgccgtgttagccaggatggtctcaatctcctgacctcgtgatccaccatcctcggcctcccaaagtgctgggattataggcgtgagccaccgcgcccggccattccgtcttatcttatgccaaaaaagaggagcagtagaccttttgggagagtgaaggtggggccctatggaacccagcctcctctggaggccttgtcacaggtttgtgtgtgtgggatcaagggctgggagcccaggctgtgctcagtgggggggctcatcagtgaggccaggcaggagggaggcgcgtagggtggcaggagggaggtgcgtagggtggcaggagggaggtgagtagggtggcaggagggaggcgtgtagggtggcagcatggaggaggaagccgggcacagagatggcatgggggctccccaggggagaggagtgtggccagagaagtgacaaccagattgaagttggtgatgagagagagggaggggcaggaggcagaagggacttgagccagcctggggaaggagtggaaagggaggcccagccaggatgtggtggaaataactccaggcaagtgggggatctggattcttcctgtgtgaccttgagaaaggcaaattcgctttcctgggctcctggctcctctgtgtcttcctgatagtcgatggtctcttcactttgtgtcactgagtattttctcacttaaccccccaagagcttcatgcggtaggcagatctagtgttatgcccattttacagataaggaactcagactgagagtcagaaaggctgggtcacttaccccgagttacacagacagaaagtgtgtggctggaacaccaggccctacatctcagagaggttctggcttgggtgctctttctggggcaccatgtggccctcctaaaatagccagaggtagcagggacggaccagagggcagtgtggtggttggagtgctgtctgacccatttgctagctgtgccaactggaataagtcatcatgcctcaggtttttcacctggaaaagggaatgacaattgtgttagctaacagtggctaacggtatactgtgttacactgaagattaaatcatgttaaataagttttagcctaaagttgcctctttacatttttaaagtttgtcctaaaggtttcttcatgcatagtgaactgccacctaactagatatgtaaacacactataacctacctttatagcaatcacagagttttggccaatgaaaggcagcccacttgtcaaaccttgtccaaataaggcaaacgccggsggtgtaaccaatccgggtgtttctgtaccttacttccgttttctgtrggtcactttccttttcctgtccacgaatattatcgaatcatgcagcagcccccagagtcactstgaatctattctggttgggggcrgggggcactcgattcgaggttcattgtttgctcagtgaaactcaagttaaatttaatttgtttaaagtttttcttttaacaattaaataatgtacattctaataccacagtgcctggctcataataagtgctcrataaacgctagctatgcttgccattcttttaattataaataacgagcaagtctcttagaatgccaaacacaccttcaaccagagctacattttctcctgtgagaagttcaggggctgccagagctgatgcctaaggcccagccagctagacttttctggtagagatggaaatagagctgaatggaagaggaagtgaagatctggactagacggtggttaatgtagctgcacgttaggaccacgtgggggctctttcaaacaaccttgttctggctccagcccagacccattaaatctgaatctggcaagtaagaccctgcactggtatttttttctttaagtgaggcataattgatgtacaataaaatgaacaaatcttgagtgcccactcaggtttgacagtcgagatgttgaacactcccattacccggtgccccctttccatcaattcctcttcctctcccactgtcattttctgaatgctatctctatcaactggttttgtctgttcatagaattcgtataaatgggatcatacagtatgtattttcttgtatgtgtgtctgacttattttgcttaatgtttctggaattcttccctgtgttttttgcacgtatcagttcctttttattgctgagtggttttgatgagcctattctrgttgaggggctgcctgatttgagcatcgttctttgctcaagtcaactctgttaaatttaattttgcctaacgttcttcttttaacaattaaataatgcacattctaataccatagttcctggctcatagtaagtgctcaataaatgctagctatgattgccattcttttttatttttttaagacagggtcttgctctgttgcccaggctggagtgtagtcacacgatcacggctcactgtagcctcaaactcccaggatcaggcaattcttctgcctcagtcttctgagtagctgggactacaggtgtgcaccaccacatctggctaattkttgtattttttgtagatacaaggtttcgtcgtgttgcccaggctggtctcaaacttctgagctcaagtgatccacccacttggccttccaaaattctggaattacaggtgtgagccaccatgccccgcrgattaccattcttttaattagcagtaatgagcaagttttctagaatgccaaacacacaccttcaacacacctttgagttgcttcaggctttttggctattataaataaaatggctatgaacattcatgtacaaatctttttcttttttttttttttgagatggagtttcgctctggttgcccaggctggagtgcaatggcgagatcttggctccctgcaacctccgcctcccgggttcaagcgattctcctgcctcagcctcccgagtagctgggattacaggcatgtgccaccacgcccggctaattttgcatttttagtagagacagggtttctccatgttggtcagtctggtctcgaactcttgacctcaggtgatccacccaccttgccctcccaaagtgccgggattacaggtgtgagccactgcacccagcctcatgtacaaatctttatgttctaatgtgtttcgggtgcggcctaaacaccgtaaattaaacacagctcactgtaaatccctacattccttcttaatatgttcatcaattgatggacatttgggttatttctactttttggctattagaaataatactggtatgaacatttgtgcacatttgtgtgtgtatgttgtgggggcatatgctttcatttctcttaggagtggaatggatgggttatatggtaactctatatctaactttttgaggaacttccagattgttttccaaaatgatcgtatcattttatattctcactagctgtgtacagggtcagaatcttttaaaaatgtaggtctgttcggctgggcgtggtggctcacgactgtaatcccaacacattgggaggccgagacgggcggatcacgaagtcaggagatcgagaccatcctggctaacatggtgaaaccccgtctctactaaaaatacaaaaaattagccgggcgtggtggcacgcacctgtagtcccagctactagggaggctgaggcaggagaatggcgtgaacccggaggcggagcttgtgagccgagatcacggcmctgcactccagcctgggcaattgagactccgtctcaaaaaaaaaaatgtaggtctgttcataaagtgcctactacatacggttgttctagggattatttgttagatatttttcttacaagagaattttgcctaccccaaggtcaggaagatatcttccatcttctagagtgtttatggttctgaatttcatgtttacgttatgatccatcttgaattaatttttgcctgtatagcataaggtagagattgagggtcattttttttccaatacagtattcagttgttctagcagaacctgctaacaaattttattttctacactgaattgaattggtgttttggccaaaaatcagttgaccatctatgcatgagtttatttctggactctattctattccattgatctattgtctctccttaccaagaaccgcattgttttgattactgtggctttatagtaaatactaaagtcaggaggaatacattttccaacttggctcttcttttctaaaattttctagctattctagattgtttgcatttccagataartcttagaagcagtatgtcaatttctttaaaaatacctgctggggccgggtgcagtgagtggctcacgcctgcaatcccagcactttaggaggctgaggctggtgattgcttgggctcaggagttggagtccagcctgggcaacgtggtgaaaccccctctctacaaaaaatataaaaattagcttggtgtggtggcacacttttggtcccagctactagggaggctgaggcgggaggattgcttgagcccaggaggaggctgcagtgagcggcgattgtgtcactgcaccccagcttgggtgacagagcaagatcctgtccaaaaaaaaaaaaaaagctggaattttgatagggattgtgttgaatccatatatatatatatctccacttattctgatctttgatttatttcagcagggatttcaatatatttttcagtcttgcacatcttttgttacatttatttctatgtatttgatgttgtttatgttatttaatattgctgttgtatttctggttttccaattttctgttgccagcatgtagaaatgcaattaatttctttttgagacggaaatgcaattaatttttttttttttttgagacggagtctcgctctgtctcccaggctggagtgtagtggcgcgatctcggctcactgcaagctcygtctcccgggttcacaccattctcctgcctcagcctcccgagtagctgggactacaggcgcccgccaccaagcccggctaattttttgtattttttttttttagtaaagacggggtttcaccgtgttagccagggtggtctcgataccctgaccccgtgatctgcccacctcggcctcccaaaatgctgggattacaggcgtgagccaccacacccggcctaaatgcaattaattttttttgtgtatttgttgtgtaccctgcaaccttgttcagtttgttagttctatatttgttttgttttggtagatkacatccctcaggccctgctactctggactttcatgatggagatggtaataggaattgtattaagaaggaatgtagggatttacagtgagctgtgtttaatttacggtgtttaggccgcacccgaaacacattagaacagtctttggaggagggaggcggggtgggtggggcatcctgtatttttagagttggagattctaaaagttcagttgtgaactcttgatttcggtgccaagcggcactcaagccgaaaggccaccgacactcgcctgcggggatcagggcgggatgacctgggtaccgcggtcacgccaaggccgaggccctcacccttcccctctttgggaaagggcagacaagttccgggttcccttctaggtccgggcgagggggagagcgccccacagacgacaggcgcctcctgcctctctccttcaataaacagtccacagtgtcccggctgggctcgccgtggcctccgccttcccggcggacacacctgtttacccttcaccgccggacggccaggaggcgccacgacgaccccagccccgcccaggcttctccgggatggaccggcctcccggggcacagatgaggaccctgaccccggaggggccagacactcgctccagggcccctggcctgaccctcttcccctcgccccttcaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctggtgaggcccgcagcgccgaggggcccgccccgcccctcgccggcccctggccccgcccacccatgggctccgctcctttcctgacccgcccgcgcagcccagtgacaccacgcggggcctcgtgggctcgcgggcaaaaaaaaaagtaaataaatacaaataataactagataattaaaataacacctcttggtgcccaagcttttggggcctcctccctggggtcctatgtagaagcatttcaggggtaggaagtcaaatttattatggaaaatgaacttttattattattattattattattgttttactgtttctggtccttgattcaggaaggaaaatgcaactttctgaattccagtgcccactagtgggactcagttaggaccctccagcgtgatggagaactgggctaacagcccaagatagagaataaggagacagtaaaaaaaggaaacttagctgggggcggtggctcatgcctgtaatcccagcactttgggaggctgaggcgggtggatcacctgaggtcagcagttcgagaccagcctggccaacatggtaaaaccccatctctactaaaaatacaaaaattagccgggcttggtggcactcacctgtaatcccagctactcgggaagctgagccagaagaatcgcttgaacccgggaggcagaggttgcggtgagccgagattgaaccactgcattccagcctgggcgacagagcaagactccatctcaaaaaacaaacaaaaaaaaggaaacttaattttttttttttttttttgagacggagttttgctcttgttgcccaggctggagtgcannnnnnnnnnnnnnnnnnnnaggaagtcaaatttattatggaaaatgaacttttattattattattattattattgttttactgtttctggtccttgattcaggaaggaaaatgcaactttctgaattccagtgcccactagtgggactcagttaggaccctccagcgtgatggagaactgggctaacagcccaagatagagaataaggagacagtaaaaaaaggaaacttagctgggggcggtggctcatgcctgtaatcccagcactttgggaggctgaggcgggtggatcacctgaggtcagcagttcgagaccagcctggtcaacatagtgaaaccccatctctacaaaaaaaaaatacaaaaattagcccatgtggtggcacaagcctgtagttccagctacttaggaggctgagatgggagaattgcttgaactcgggagatggagactgctgtgagccttgatcacaccactgtactccagcctgagtgacagagtgagctcgtctgccaaaaaaaaagaaagaaaggagcaagggaaaatgagggaggagccaaggaaaggagacagggaagttcccattagtaagagtgggctggggactggagtcctagtcccagctcttgctgggacaaatctcttgatccctcagtcttcccatcagtgaaatgggagggaaagtcttgctccttccaccctaggcaggggaggtataaatgaaccaaaaccgtgtgtgtgcagctactggtctcctttcctggcctgcaactcccttaatcccatgctcccctggtccatgctcctagggacttctgcttctcttccacttctgtctttccccactcctggcttccgactcctgtccgtcagtcctcagaaccccagatcactcattctttgcccttggccctgccaaggggcttatccccggctgcgtgtcccctctgactctagtctctgtgtccagtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgtgagtcagtcctgcctggctccttgctctccgcggggtccgcttccctgggtcagcctcacgccctgcatgggcagggcccaggaaatgcttgttgactaaaaaaatgccagtgccagcaggccagggggaagcactggctttgkgcccacaccctgccccagagagcgccctacgaactcctgctgctccctgcactgctggatctgagggaagtggcctcacaggatgccttgggaagactggggctttgagaaaccaaaggctggaagcatggatcttggtcttttttgtttttcttttttttgagatggagttttgctcttgttgctcaggctggagtgcaatggcgcgatctyggctgtctgcaaccttcacctcctggggtcaagcaattctcctgcctcagcctcctgagtagctgggattacagtcatgcgccaccacgcctggctaatttttttatttttagtagagacgttggtcaacgtccatgttggtcaggctggtctccaactcctgacctcaggtgatctgcctgccttggcctcccaaagtgctgggattacaggcgtgagccaccatgcctggccagggtcttggtctttctaaggcccctttctccctagcatcaaagctcaaaagggcctaggagatcatctgtctcatactctgttccctgagctgaggctggcagtagtagtgaggtggagtggcatgggttgagggactaaacctaagttcccactctagctctgtcacttcctggccaggtgactctggatgtatcacatcatccttcagagcctatttcttagattgtaaaatggaagtaaaacaaaaaatgagattcattcagtgttcgttcaacaaatagttttgactatctgggctatgtgccagtcactgttctaggcatttggactacatcaaaggaaaaactatataatccatgctcctttggcacttttactcaagtgacgaagatgatgacgataacactcatctcaagagctgtaccaagtgtgtgagatacaaacgtgagggcactttatagaccacagtaaatgatgggtttcattactcttgtactcaaacaggtgaagtgacttgcccttgggaatgggccggccctggctaaggattcttcccaccccactacccctcgggtattcattctgtgaggacccctgttataatgtccttgcaagcagctcatagcagctgcaggttctctgagggctgggagaggctgaggcgaggggggggtccccttctgtaacctctggccccctcctcccctgccttctcctcctgctcgtttattttccggagccatctccctgcctctgcctggctccactctacagggggcattccctcccctgttgctgaagaatggccacagggcaaggtgtcacttcttacccttcacacacactctgcccagtacacgattttgttctgtttttagtctttgcatttgtttgaggacagaaactaccagctgggaagtaagatggtagcaacacctaagcctgagtcmgcccacacctgtcaccaagttcctctaactgtcacctggacacctgtgctttccctatgccctcacccgatgcctccctttgctctgtgtgcctgcctccccatcaacagaaagtccatggacacctgtgctttccctatgccctcacccgatgccctccctttgctctgtgtgcctgcctccccctcaacagaaagtccatggttcatctttatcttggcacttaggcgcttaggtcagctcagagcctcattgctcgcctgggttgttatacccaccactccaccctactgcgttcttttgcctccaaatcctcccttccttctgcaactacaggaacctttgtacttcaaccttacttcacgtcaccacatgtaactattccagttagtcctgtgtgttagtccattttgtgttgctataaaggaatatctcaccgggcacggtggctcatgcctgtaatcccagcactttgggagaccgagatgggcggatcacctgaggtcaggagttagagatcagcctggccaacatggcgaaaccccatctctactggaaatataaaaattagccgggtgtggtggcacacatctgtggccccagctactcaggaggctgaggcaggaggattgcttgaacccaagaggtggaggttgcagtgagccgagatcgcaccactgcactccagcctgggcgacagagcaagactccatctgaaaaaaaaaaaaaaaaaaaaaaaaggaatatctgagtctgggtaatttataaaggaaagaggtttaattggctcagggttctgcagattgtacaagcatggcaccagcatctgctcagcttctggggaggcctcaggaaacttttactcatggtagaaggggaggagagggggcaagagagagagagaccaggcacttttaaacaaccagctatcgggtgaactaattaatagtgtgaggattcactcattactgtgaggagggcaccaagccattcaagagggacccacccctgtgacccaaacacctcccagctaggatcacctccaacatgggggatcacatttcaacatgagacttggaggggacaaacatccaaactgtatcctcctgtttaaaatcgttcagtgtctctcacggcctccagcatcaagttggtactccttagcatggctttctcacccctttcctccccgataactacacccttttcccccaccctataatctttttttaataacacttttattgagatataatttacaaaccataaatgtattcttttaatatgtataatttagtgatttttaatatatttggagttgtgtaaccattaccactacctgtttttagaatattttccttaccccaaaaagaaaccctgtacccattagcagttcttccccattttctcccctcctccaagccctgagagccactcttctgctttctgtctctatggattgcctgtggtggacatttcacataagtggaatcatacaatatgtggtcttttgtgagtggcctctttcatttagcataacgttttcaaagcttatccatgttgtagcatggatcagaacttcatttttatggctgaatactatgatattgtgtagatacaccaccttttttttttttttttttttgagacaggttctcactctgttacccaggctggagtacagtggcacaatcagacctcactgtagctttgatttcctgggctgaaacgatcctcctgattcagcctcccaagtagctgggactacaggctcatgccaccatgcccagctaattttttttaattttagtagagactaggtctcactatggtgcccaggctgatctcgaactcctgagctcaagccatcctcctgcctcggcctcccaaagtgctgggattataggtgtaagccaccacgcccggcccacatttttgcttatccattctcagttgatggacatttggattgtttctactttttggctgttatgattaatgctgctatgaacattcctgtacatgtttttgtggatcctgtacatggatctatgtttttatttctcttgggtgtttacctatgagtggaactgctgggtcatgtggtaactctatatttaacattttgaggagctaccagacttttccaaatggtcacaccatttaacattcccaacagcaatgtatgaaggttctaaattctctacctcctcctcatgctgttgtctgtctttttgactttagccatcttaatgaatccctgtaatcgtactagtgagctaatacagctcttactaaggctagacaccattctaagcataatttcatgctcaacacccctgtgaggttgatatttttattatccccattttacagctgaggaaactgaggtacagagagattaagtaagtaacttgtttggtcccacatctaatacttgttagagccccaggattcaaatacaaggaatttaattctggagtctgtgctctttttttttcttttggagacggagtttcactcttactggccaggctggagtgcaatgkcgcaatctcagctcatgacaacctccacctcccaggttcaagtgattctcctgcctcagcttcctgagtagctgggattacaggcatgtgccgccgtgcccggctaattttgtatttttagtagagatggggtttcaccatgttggccaggctggtctcaaactcctgacctcaggtgaccccacccgcctcggcctcccaaagtgctgggattacaggcgtcagccactgcgcctggctgagtctgtgctcttaaccatcacattatactgattctcataggccactatagtaatgtgcttagtgtgtatctctatgtgtttttgcaaaatctgtatttaatttatataaatggtattgtgttatagatctcatttcacctcttactatttttttttttgagacagagtctcgctgtagtgtgcagtggtgcaatctcagctcactgcaacctcccaagttcaagcgattcttctgcctcagcctcccgactagctgagataataggtgcccaccaccacgcctggcgaatttttgtatttttggtagagacggggtttcaccatgttggccaggctggtctcaaacttctgacttcaactgatccacctgtctcagcctcccaaagtgttgggattacaggcgtgagccactgtgccccaccacttttttttttcgaagctctatgttttaaaacccatccgtgtttctccaccgctgatggaacttgtgcctgctttccatgggggcagcacccaccattatacttgtcccctctctgtgtgcgaagggctcaccagccttcaggactggccacctctgtagcctctccttcagtccttccctgcatctagcctgggctctagaagtgctgacttcccagtacatcctagaatgtgcaccagtatgtcacgcctctgtgcctttgttcttcaaggccagtggaatatcccggatcacctagttccaatctcctcattttacagaatcatcctacattttacagaggaggagaataagcttagaaacaatgacctgcttgagaccgtacaaccagaaccccaccctttatctctggccagcctcttctccctcttctctttagtcctcctctgctgctcactggccgaagtcccctttccgtctttgcctggctcccgtcgctagctccaagatggcagggtagcagaacacagatcctctctgtgccgtgtggcacatgtgctgtgctacaacccacacagcctccctgttctggaacctgtgatttgctgtgaaattgcagtcctactgcagctgtgttgcctctgtgattgctttctctctgtccccacacctgtcacagatgagttttggacctaccattctgagacatactgatgcaagaggctcccaggaaacacttggtactgatcttcctcccctcagctccgtgctcaccactggtcacactttctcctttaaccctgctcccctcctccccttcattcattcattcattcattcattcattcattcctcactcaacaactatttattaatcatctcctctatctsctagatgacaggatctatgcaactaacccagagatgacacagagatgaatgagatgtggctcctgtcatcaaggagctcatgattcaatggggaactaacacttagatgcatgggcagttagggacatgcaagaatctttgtaatgcaacaagagagaagttacaaggcagcacggaagtcaatgccggtgaacccagatggcctggtgagaggagcctggactagaaggtagatgtgtgaccttgggccagctgtttgagctctctgagccttagcttcctcctctgtgatatgaggatgagactctcacaggctgttggttggagtgactgagggagtgtgagtaaagctctcagcattgtgccagcacatagtaggtgatcaggaaacaaatggctctgaaaggcacaagtcctgtaggagtttaagagagtggacatttctctctgcctcatctccctattccctgcaccacctacactttcctctctgaccctactctctctttcctgataaggaattactctcacttccaccacccgatgtatggaaactgctatactttcaatgacaagaacaactccaacctctggatgtcttccatgcctggaatcaacaayggtgagaagctccctgcttgctccatggcgccctctgcttcagccactcacctgtacttaccttgagctcacctcctagagctgctgggaggggtcctgcctgctgtctctccccaataggtgccacatagtccgttccaggcatgagaggaatcccgtcccaggtcttcctcctgcctccagattccagctcaggggttgccaggtccctttgcgggtcttcctgaacttgcttctcttgcagctttagagactgggcaaggaagggagagtggatttccatctcctaactcttttctaggattcccgcctctgccaactctgctctctctgcacccctaggtctgtccctgatgctgcgcrcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggcaaggatgctgactgggaggcctggaaggagcgcctcagattgcagaggggcagcggggaggcatgggaggctggagagggagagcatgtggggtgggccttgagcatgtggaggtcttcaggagcaggaatgaggggcagaggggctggcactgggaagtaaagccctgcagggtggaccctgggggacaagtgctgagaaggcattcaaggcatgcttagggtttctggggatgctctgggcctagtggccttgaaatgagcagtgggtgggcatgggggtggctggaagcatgtattgagagggcgaggccagtaggaggggctggcaggtgtgagatacaacctggaactgagggaaggcagagaacccagaggcacttgctctgtcctctgatctcttggtgtatgtgggttcataggaaaccctggacagacttgggggcgattatggcgactgcaccaagaatggcagtgatgttcctgttgagaacctttacccttcaaagtacacacagcaggtgaggcccaacctgattccgtggcagccactcccagccactgccctggctggycctgcaaagctggaggggttgtgtatgtgagagagagagagggaaactggggggtggtggaaagaggatggaggctctgtgcagagaactgctgagttcaggcctgaaccccctctcctctccaccctcctcccttccaggtgtgtattcactcctgcttccaggagagcatgatcaaggagtgtggctgtgcctacatcttctatccgcggccccagaacgtggagtactgtgactacagaaagcacagttcctggggtgagactccagggagcccccaccctgccccactgaccccagtactcactgaggcactttttcctctcagtcccctgtttgtggggatgacttctggctcccacctgctgggatgaatccttccttgctcttgtttttcagcctttagtctctgcctctgtcagtttccctctccctcagtctctctctctttttttctatttttttgaaatggagtctcgctctgtcacccaggctggagagcagtggcgcgatctcggctcactgcaagctccacctcccgggttcccaccattctcctgcctcagcctcctgaatagctgggactacaggcacccgccaccacgcccagctaattttttggtatttttagtagagacggggtttcaccctgttagccaggatggtctcaatctcctgacctcatgatccacccgcctcggcctccctctctcttctatctctgttcctccctctcagtgttgcagtctctctgttttggcctttgtgtgtttgtcaaggaattgtcccatttaaaaacaacctgcaggccgggcgcggtggctcacgcctgtaatcccagcactttgggaggccacggcgggcggatcacgaggtcaggagatggagaccatcctggctaacacggtgaaaccccgtctctactaaaaatacaaaaaattagccgggcgaggtggcgggcgcctgtagtcccagctacgtgggaggctgaggcaggagaatggtgtggacccgggaggcggagcctgcagtgagctgagatcacgccattgcactccagcctgggtgacagcgagactcggtctcaaaaaaaaataaataaataaaataaataaataaaaataaaaataaaaacaacctgcagcagaaggaaggaagagcacgtgagaaaacctccagcggttcctcaatggctcctaaggtttcagtgcatgctctgcccacagcttccctgctcagtgcccagggcgcttagctgggcaggctctggaggggctgggtggggtacacaacacttccctggggagcaggaagaaaatattagaagatacatgggtctgtctcattccttcacattttccatcttatgtgctttagaatggacatactgtatccattcaatagtagaggtatataatttataaatcaaatacatgtattggacctgtttaagattttttttttaactgaacaagggcacaatcagtaaagtttggagcaccttggaatctcctccttatcctggtataggactagacaaatctctttccttttgactacagttgagttgtttggcagggaagtcgtgtgccaggaagctgagagagaaagaaaatcacaaaaagaaaatatgtaagctgcaagggtttgcattcctggagttcatgctcttccctggcacagctggcctgttccccctgcagttcctcctcccagggctctcccctgggcccagctgtcccacagggtgggcggagggccatcacgggaggggacatggtagtgggcactggagacacagaggccctcaaaggcagcggattgtctcaccccagagttcagcgtccatccctaccttgttcctgtctgtggtgacttttccacttctgtccttccctgggctggctccgcagttctcttctgcctggactttccagtcgtggcctcctggttcctgtctctctgaccttagaggattgtagcacatcagaactgggggaaacccaaaggccatctggcctcatctcctgtctcagatgagcaaattaaggtccagggggaggatgtgacacgtcccagggtatacagaactgggatggaggagatgccacctgtgatttctccctcccctcaaataattatttctactttgtgggtttgcacatctgtgagtgaaaaataacaatattgattgctgagaagttgtgaggatgagagaggaagtaaggctaaaagcacagtctgttgcatttcctagggcttacttccccggagaagagggccagctgcttccccttcttcctaaagatctccagccctggtagggatttgggtcagaaatgaagaaggacttcagactgaggaactaaaagtagcaataatgacaaaataaccttacttagaatttgggaaataggggaggaggtgaatctacagttccattattattattattattttggtaatagctttattgagataatttatatcccatacatttcactcatttaaagcatacagcttcattttagtcaaattttagttttaattttacgttttaagtatagtcccagagttgtgcaatcatcatataatcagttttggaatatttttagtgttcccaaaagaaaccctgtactcactcaagccaggcacagtggttcatgcctgtaatcgcagcactttgagaggccaaggtgggcagatcacttgagcccaggatttcgacaccagcctgggcaacgtggcgaaaccctgtctttacaaaaattagctgggcatggtggtgcacacctgcagacccagccacttgggaggctgagctgggagaatcacctgagcccaggaggtcaaggctgcagtgagccatgatcaggccactgcactccagcctgggcaatggagtgagaccctgtctcagataaataaataaataaaccttgtactcattagcaagtcccaagcttccctcccctcctccaccactgccagcccttgggcaaccacgattctttctttctctctctatggatttgcctattctgaatctttttttttttttttcttctggagacagaatctccctctgtcgcccagactggagtgcagtggcgcgatcttggctcactgctacctctgcctctcaggttcaagcaattctcctgtctcagcttcccgagtacctgggactacatacaggcgcatgctgccaagcccagctaatttttgtattttttagtagagatggggtttcaccatattggtcaggctggtctcaaactcctgacctcaggtgatccgcccacctcagcccccaagtgctgggattacaggcatgagccactgcgcccggctattctgaatctttcatatagatggaatcttagagtgtgtgaccctcgtgtctgccttatttcacttagcataatattttcaaggttcatccgtatggtagcaatagcagtgcctcattcctttatatggctgaataacaacactcccttgtatggatagaccacactttgtttacccatttatcagttagtggacatttgtgttgttgccactttttggttattgtgaataatgctgctgtgagcatttgtgtacaagtttttgtgtggacgcatgttttccattttcttgggtatatacctaggaatggaattgctaggtcatatggtaatctatgtttaaccttttttgaggagctgccaggctgttttccgaagtgacatcaccattgtacatccctagcagcagtataagaggttttcagtttctccacatcctgccagttcttgttattgtctttttaaatttttatttatttatttatttatttatttattatttattttgagaagactctcactctgttgcccaggctggagtgcagtggcacgatcttggcaaactacaacctccacctcctaggttcaagcaattatcctgcctcagcctcccaagtagctgggattacaggtgtgcaccaccacacccgactaatttttgtattttcagtagagactggatttcaccatgttggccaggctggtctcgaattcctgacctcaggtaatccacctgcctcagcctcccaaagtgttggtattacaggcgtgagccaccgcacccagcctattgtctttttttaaataacacacatcttaatgggtgtgaagtggtatcttattgtggcttaattcccttattcttatacaattattgttcccatttttcttttctttttttttttttttgagacggagtctcgctcagtcgcccaggctagagtgtgcaatggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcttgacctcgtgatccacccgcctcggcctcccaaagtgctgggattacaggcgtgagccaccacgcccggcctgttcccatttttctttatggcgtttatgtttttgtccatagcatatatttccttacactggtgtatcctgttttgtttttcgcctgacttagcttattttctttctttattaatttattttttaggccaggtgcggtcgctcacacctgtaatcccagcactttgggaggccgaggcgggcagatcacgaggtcaggagatcgagaccatcttggctaacacagagaaaccccatctctactaaaaatacgaaaaattagccgggcgtggtggcgggcgcctgtagtcccagctactccggaggctgatgcaggagaatggtatgaacccgggaggcggagcttgcagtgagccaagattgcgccactgcactctagcgtgggcaacagagcgaaactccgtctaaaaaaaaaattaatttattaaaaatttttttttttagagacaaggtctcactctgttgccagagttggagtacaaaggcacactcatagctcacttgcaaccttgaactcctggcctcaaacgaccctcccacctcggcctcccaaagtgctgagccactgtccctggcttagcttaatttcttaaacgcttcttggtactgccactcataaggcatcattataatgctaaataatgctcttgtaaagtgggtacccagggatcttgggagacctcttgggtgtggggtagagaaagctgaggtgccctaggagaacaggcatctctctgtacccacagggtactgctactataagctccaggttgacttctcctcagaccacctgggctgtttcaccaagtgccggaagccatgcaggttagtgtccccttccccgggtacaggttgggtagaatacaggttaccgagccaagcatttgggagagctctgccccaacactgagcacctttctccatccccagcgtgaccagctaccagctctctgctggttactcacgatggccctcggtgacatcccaggtagagtgtggggaagggatgggtgggggatgtgtgtgcccatgtaatgctgtggscttctctgggtattatgtgtatgagtgtgtttgacacaaccctatccctgtaagcctgaagcatatgggagtgaccttgatgacacccccattctttcctaggaatgggtcttccagatgctatcgcgacagaacaattacaccgtcaacaacaagaggtcagtcctgccctggtcccagccacaagaarggaatctttgggagggaaaatagacctaagaagagggatcgatatggttgattagaggaaggtccaggaaattcatcctctaccatttcttcccaccctctgccccacacctaagaaatggagtggccaaagtcaacatcttcttcaaggagctgaactacaaaaccaattctgagtctccctctgtcacggtaggtcgtgcctggatggagcctgtgatgctctgggggtcttacttagcagggcggctgtcggggaaaaccaaaaggttgtctctgtgggccagaaggctctgagtctcaaaggcaggggaccaaagaagagggtcaagggagaggttgggagggttggaagaaggagctcggccggggcataaggtctctgggggtggtgggagggacaggcatgctagatgctggggtgaaggcgcttgacccatgcccccatttcagctgcccctaactgtgggccagttatcagttttctctgggtgacactggccaggagcagagacaaagagcccagggggctgctgagaggctgagaggactcgggggtcttcagggatgaagggagacagcttggtgaggagggaagggggctcctctgccagagtccatccagaaccctctgtcccatcgtcaatgtacctctcctctcacagatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctkcccccaccccatgtctctgtccttgtcccagccaggccctgctccctctccagccttgacagcccctccccctgcctatgccaccctgggcccccgcccatctccagggggctctgcaggggccagttcctccrcctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaatgtctggagagctggatggggcatcatgaagagggtagggggtggatacaagtcatcacccaagcttctgggaggtcctggggctgggagagggtacagactcccatgccccttggctgcaccatggaagtgaccattcttcacggggtcttaagagggacaaacgttctggtgaattcctccatgggtgttgctgagcgtctgctatgtgcccatggccatgttagggtggaagggggaagacatgatgccaccccttcaggggacctacctcacagtgtttggggagacttgccctctccactgtctgaacctccttttccttctctgctttagtcaccatcatcactaacctccccatcccccactccacttgctgagtcccacttaccacctggcggcaatgaaccctcatctgcctgcctcccatcagctgtctggtggtggtggaggatgatgaggctcaggccagtttctcctggaaatgcaaagccttatatggtcttattggtacatgattgcagagaggggcacagggaatcctcccagctttagtaaaggagagactgaggtccagggaggggctgaaggatgtgcgagtggaactccagctctccgatccttgtttctcccccactccagcataagacctggaatccagaagtgaccctttctcaccatctttggggattctgtccctgccaccttagtcttattcatcttaattgcagtctccctgttctgaggagccaaaggaggaagagactttcggggaaagaggagaaggagctggtgacaggggtaggaaggtagacagggtcatgacctgaaacggtgtgacgactgctgacttccctttcctggacttgagctgatgaaggggaaatggtgttgcagtctcctctgtcagagccctcaggtgcagacggcacttgtctgccccctcagcctcagccttggcccacctggtccccagtgccctctcctctggctggggcaggaggacctgccggacatagccagatgtattacggatgactgcagtcagctcccccaggctcctgcttctcttgcctcctgcttttttccccagagctgtctccttatctccattcacttgtctatgggttactcctggaccctggggttaggagttggaatcaggctgttagcgataaaagggttcaagttgactcattttccttatcaggcttagtagttgaagtgacttgctgagcttcataattcttagagaacctgccatgaacccagctccctttctatgactcaccctgccaccctgtgacacatagagtctgaatggcaggtctggggctagaacccacgtcatctggacttggagtccagtgaccctttgggttaagcatgtgtgtgtgtgtgtgtgtgccatgatgcgggaggaaggtccctgctctctgtagctgttttcttcatcctttgctctacaagccctaacagccgattctgtcatccctagtctgcccctctcctgtttctccatctcctctgaccatgatttttttctgtccctggagggatgatggtctcattctcacctcctccacgaaacgtgttagcttttcatattcctagatccactcacttctcatcatctttttttttaaacaaaattttattgaaaaatgtaatatgacgtgtcaaagttgtaaagttattgagtaaataagcatgtatcctaaatattgaaaaatattctccttttgtaccaggctatgtgtcacggctttggcgctttgcacagactattagaaataccttataacattaaaaataggacattgaggccgggcgtggtggctcatgcctgtaatcccagcactttgggaggccagggtgggtggatcacctgaagtcaggagtttgagaccagcctggctaacacggtgaaaccccgtctctactaaatacaaaaaattagccgggcatgatggcacatgcctataatcctagctactcgggaggctgaggcaggagaattgcttgaatccgggagtcagaggttgcagtgagccgagattgtgccactgcacttcagcctgggcaacaagagtgaaactctatcaaaaaaaaaaataggacattgaagttggtttctttttttgatacagagtctcgctctgtcacccaggctggagtgcactggcaggatctcggctcactgcaacctctgcctcctgggttcaagcaattctcctgcctcagcctcctgagtagctgggattacaggcacgcgccaccacgcctggctaattttgtatatttagtagagacagggtttcaccatgttggtcaggttggtctcgaactcctgaccttgtgatccgcccacctcagcctcccaaagtgctgggattgcaggcgtgagccaccgcactctgctttttttttttttttttgccgccctctcacataccatactcccctgtatcacttatccttctgaagttgttattaaatcattaatacaactagctgggcatagtggtgtgcgatggtagtcttagccactcggaaggctgatgtgggaggctagcttgaggccagtagttctaggttaggtgagctatgattgcaccattgcactttagcctgggtgagagcaagctcctgtttcaaaaaaaaaattaattgctaccacttactaaatgcttaatatatggcaaacacttgccaaacactttatatgcttgatttaagcatcaagctagctctgtgaagggtaccagcaggtttcccattttttagatgagcagaccgaggttcttctcgctgcttcatactggaaacttgcacttgattctgaggctcctgcttcttcaagaacactgctttgggttcgcttctcctgtccctggggtctccctttgtgatggtggtgagctgcttcctttctgaatccagcttcaaccctacagttctccagaagctggacgatggggtggagtaaagtcagctccccccgcagtgagggacactgaagctccattctcatctgcggatcacagaggggaagccaggaagagccaggggacggtggacttggggctgggaggtcatctcagagggataaggggtgaggagctctggtttcaagttccaaagccctaggacctccctcttctctgtctgcctgcatttctagcagcctcagcagctagcaggtctagctgcctgcatttctagcagcccagcgcccttgggcggggctggatgtagggaaggtcattgtaccaagaagatagttgggtaaatgtggtacctttgttgtaggattctcttgggagatgtctgcatcaatgaggatggcataaagtaaccagagtcaggatgtggggtctgactcagtgacagaaaaagtggcagtgtgtctctcatagccaaaggggcccttggaccggcagtcgggagtctggggttctctgttggctctgcctcctggcacattgggtttctggacctcagttttctcctctataaaaccgggcagttgggtgggcacggtggctcacacctgtaatcctagcactttaggaggctgaggtgggcagatcatttgggcccaggagttcaagacctgcctgtgtaacatggtgagaccctgtctctacaaaaaatacaaaaattacccaggcgtggtggtatgcacctatagtcccagctgcttgggaggctgaggtgggaggattacttgaacctgggaggtcgaggctgcagtgagctgcgatggtaccactgcactccagcctgggaaacggagcggaccctcaaaacaaaaacaaaaatgaaaaacaagcaaacgaagaaataaaaaaacctagggggttgtagtcgatgatctgtaaggtgagttataattgatgtattggaatatttaggaaaagggcactgggaatatgctaggaacacctgatggaggtatctttatttccacggcagcttcgtggatacgtctcattgattctcatggcatcactttccccatgtaggtgggcagacattgttacccctgtttaataaacaaggaaccaacagaggcttaggagaggagttgcctgatgtcgcatgattggtggcagagccaggatcaacagtggggcagggtggggggacctggccaggcagagactggatgagacctggggtgaggaatggcaggcacccagtcagggcagaaaacgagggttgggacttactttgagttttggattggatcagtaaattcccaagaaagagggagactaggaggctagtgaagaactctggagtaaaggggaggattactaagggacatggagtacctatcatgtgtcggacgcttatctatatctctcccatctgaacaaatccttacaggaaccccaggagacaggttatctccactctgcaaattggaaaacagatccagacagtttcagttatgtgtctgagaagttcatttatgtgtccaagacacattcttagctaaaaagctaagcattctgaattggaacccagagaatttgactcccagactctggatcttttcactgctgtgatccatctgggaaaggctagtgatgtgggcaaggggcttattgccccttggtgtttggttgggagtggtcggattggtgggttgggggcacaaggcagccagatctgggactcctgtgcttgtgactggactacaaagagttaaagaacgttgggcctcctcctcccgcctcctgtggcctcctcctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggacgtcctggacagaccgagtcccgggaagccccagcactgccgctgccacactgccctgagcccaaatgggggagtgagaggccatagctgtctggcatgggcctctccaccgtgcctgacctgctgctgccrctggtgagaccagggacaaagggaagagtgggctggtgggcgaggcaccttccggctggcgtgggccctctccgggagggggccgagcctctcctgcccgggcctggtcctggcgccagcctcaggcctgcaggtcctaacctcagccactgccagtgtggggttccccattcatccgccttttggagtaggggctgcgctgaggcaggggaatgggagaagtttgaaagggagagagtaaaaggaagccctggcccctgacagcggtggaagtttgtgggcggccaagggaatgtgggcaggagataggcccagggtggggcagatttggcggggaaaagaagggagtgggagtaggaagattagtgctcggggagtccagacggttctgaattctgtccctccggtcagctggctggcctggagggtgttgggccgtggggaggcgaggctgcctgtggaacttggtggagcacaccctgtagggcaggattttggcggctggtgaagtgggggagtgagttgaggagtggggatgggctggtgtggtgggtttgggatgctcatggtgggaggtatttgagaatgggctgggacactggatggggcagggcaacccagtggacagtgtccccagtgccctggccaagccccggcctctcacctggggacattctttacccttttgcctgctgctaggcaggtagccgctgtgggactgagccttcccagggagctagtcctacccccacctggtcagtgtccctgggcctgtcctccagcttcccctccccgctgcttctcacagacctaaacaacaatcccttggtttcttattctacagttcagtttggggaagttggtagaaagttgttttcgtcactggaaaatgtccctttctctggcctcagccttgtttcaatgtatccttgatcgtcctccacgtcttggtccgggaatcatcctgttcagatgtcctgggcccatctagtcaggcagat

SEQ ID NO: 17707 - DNA, 17861 bp, Homo sapiens
agatctgatataccataaatggacgtaagaaacatcactttgctttcttcccaaatctaacaaaatatgtctctaagcacctcttcccccgtgtggtgaggcattgttagttttgttaaactttttaagctgatgtcctgtccaggagcttctaggagtctcaaaaaactacaaagttcagaaaacctggggaagaccttagagcttcagcctgtcatggtcatgcctgagctattcagacagtggttattgcccaagctgacgtggtcattcaaaggcaggaggctccttttccaagctttgttgatgcccaaggcagggcaatttgtgttcaatttctccaacaactacatgccatccaagagacttcttgccactgccctggaccccacatgggagtgagatgcagagtgctaccagtcttggaatctgctaccattatcaccctagatatgaccaaatttgcctcgttaatacccagcggcctcagaaagtccctccccagcttatcctctctcagtggaacttgttttccaaacaacagcctggataggaggtagcattctggaagcatggcaacttgtgtttcttccaggaaatataaatgctattcttgcaagagttttaaatctttttttaaaaaactgtgtaataaaagtgaccctaccaaaagaacactgtactgagatattctttctagttaatttttacatggcttatatgttatctgaatgctgctcatgaagctctgtgaaaatatttcgcttatttccattgaaatttaagagaacacagatctgggtacagatgagctgcagaagaaagatgatgataaagtaacatgactgcctcaacaaatatgacagagttcatatatgcagatgaatgaggaaggcttcaaaataatcacccttactttagtaattccactatcgattaaaatatttttggaacttctctcttagagtccccttcaaggcctaaaacacactcctctctttctccctccctttctttctcttattttctcttatctccctgagatattcgttatagcttatgtcttattttgttttgcctctgtttcctttgagttcttcttctcgaaatgtttcttttgatattaatgtcactctgtctttcacaatagtgtctttcatcaagtatcctccactgattgtgtaagagtaatacaaagcaccaaggagctgagcagaaaatctgtaagcctgggtacgtctcaccacaggcaattgatcaagactggccatttcactgtgggccccaaatattaatatctataggtcttttctcctggttcagacatttactccagagaggatcctattggctcctgcctgggaggtggttttggcagccagacatcaaggagctcagttcaggcaggttgagagctgggtgactggcttactgctcagaatgcagatttgcatttaatgcccctattttcattatggcattatcccctgtctttagtcatgccttgagtcctaagtccagagtctttggttcatcctctccaaagagtgatcttctcatccttcttctagggtgggaaaaggcagcaacctggtttcctggtctgggggagaaaatctggggcttaactgttccatatacagatttccaacctgtcttcctgtttatagcactgccgtgcagtcctgccttcagaattactgagtttttttccaggatctagggcacaaactagtttgctttgtattgatttccctttttccaggcactcaggtgtcagctttctccattatcctaagttagttactactcaaccactctgtattataaacttttattgacatttctcatctattatcatctcttctgcttttcctttgcccttattggtttataccttttcaaactccttttgttgatactttaatggaatttggaaagtgaacagagagaaacctgtgtgcccatcccaccactttcaacagaaggcctagtggcttatgattgtaatcacagcactttgggaggccaagacaggaggattgcttgagcccaggagttcaagaccagccttggcaacataacgagactctgtctctacaaaaaatgaaaaattagctgtgtgtggtggtacatgcctgtaggtgggaggatcacctgagcctgggaaatcaaagctgaaaaaacataattgcactgcttcactccagtctggacaacagagtgagaccctgtgatatagtttggttatttgtgcccatccaaatctcctgttgaattataatccccagtgttggaggtggggcctggtgggaggtgtttgggtcatgggcgcagatccctcgtggcttggtgctgtcctggtgatagtgagtgagttctcacgagatctggttgttgtaaagtgtggcccccgccaacccccggcaactctcttgctcctgctccaccacgtgaaatacctgttcctccttcaccttcctccataattgtaagctccctgaggcctctccagaagcagatgctggtgccatgcttcctgaacagcctgcagaaccatgagccaattaaatctcttttcttataaattacccagtgtcaggtatttctttataacaacataagaatggcctaacagagctgcgtgcagtagctcctgcttgtaatccaagcattttgggaggctgaggcaggaggattgcttaagtccaagagtccaagaccagcctgggcaacacagcaagactgtgtttctactaaaaatttaaaaagttggccaggtgtggtggcacacacctgtggtcccagctactcgcctgtggtcccagctacttggaaggctgaggcaggaggattgcttgagcccaggagttcacgctgcagtgagccaagattgtgcccttgcactctagcctgggcaacagagcaagaccctgtctccaaaacaacaaaacaaaacaaaactggcctaacaccctatctaaaaacaaaacaaaacagagggctatagcacattctttagaatatcttaaattatggcaaatctccatcttttcaggatggttttagttttggggaatagtcaaaagtgtgagaaacccttggtcaaattccctttcctaggcctgaagcccccaacactcaccataaataattatttttctctatcttgagaaacaaataagttgagtaaatcatgactattgcccattgtaatacaacaaagtaatctagggtctgtaagcaactttcctaaaaagataaaatgcatacattgcatcaaaaagaacatgcagtacatacaaaatttctgaggaagaaaaattatctctgccctcaaatcatgcttacttgctattttatttttaaatagattgctcattaaacctacctcaaatggaatgacaggattataaatggatgttataactgcccttaacttcttccccaggggagataattaaggggatcaaaaacacttcttccctttgcagtagtcacatgataacatgctatcactttggttcaggttggcaagcaaatatttgcttgttccacttccaagaaagtataaggtcataactatttaaacatttgaaaacaaaaattaatcttatcagcataaggctgaaaccagcatatgtaataactggctgttctttagtattgagttgggaacggcataaaggggaccaaagactaactctttttttccttctttctttcttttttttatttttgagacacagtctcactctagttgcccaggctgcagtgcagtggcacgatctcagctaactgcagcctcaacctcctgggttcaggtgatcctctgaccctcaacctcccgagtagctgggactacaagcacatttttaaatttttttttatttttagtaaatatagggttttgccatgttgcccaggctggtctccaactcctggtctcaagcagtcctcctgcctcggcctcccatagtgctggaaatacaggcatgagccactgcgcccagccaagactaactcttttaattggtttctgtctctttgggtcctgaaaatctgtctcactatttattattattattattattattattatttgagacagagtctcactctctttcccaggctggagtgcaatggcacaatctcggctcactgcaacctccgcctcctcggttcaagcgattctcctgcctcagcatcccaggtagctgggattataggcacccaccaccacacccaactaatttttctatttttcgtagagacggggtttcaccatgctggccaggctggtctcgaactcctgacctcaggtgatcagcctgccttgggctttcaaagtgctgggattacaggcatgagccaccgcagctggccattttttttttctttcttttttttttttttttttttgagacagagtctcactctgttgcccaggctggagtgcagtggtgtgatctcagttcaccacaacctccgcctcccgggttcaagtaattctcctgcctcagcctcccaagtagctggaattataggcgcaccaccacgcccagctaattttgtatttttagtagagacggagtttcaccatgttggccaggctggtcttgaacgcctgacctcaggtgatccacccacctcagcctcccaaagtgctgggattacaggcatgagccactgcacctggccctatttattattgaagaatcaaaattaggcctagcctgaaaaatgagattattcttgatttttgaacagggtccttgaactgtcatttaaaaccaaatctggtaatctttagaggccactgatgaaaaataagggtaactacaaagtgatgacactttgtgtggctcagaatctgtcctcttaggcagatacagaagtgcagttctttttgagttctggtagcattgttttaaaagctgtgcacagcctcctgagattgctattttcaaaggtagcatttagttggatatatgtttgggtaggttttatttttaaaatgctgttgctttctaatgaccccttatgttctaatatggaaaggggaggcaaagtattgtgaaaagtagttggtaaagtaggccggatgtggtggctcacacctgtaatcccagcactttggaaggccgaggcgggcggatcacgaggtcaagagatccagaccatcctggccacatggtgaaaccctgtctctactaaaaatacaaaaattagctgggcatggtggtacatgcctgtagtcccagctacctgggaggctgaggcaggagaattgcttgaacccgggaggcagaggttgcaatgaactgagattgcgccactgcactccagcctggtgacagagtaagactccatctcaaaaaaaaaaaaaaaaaggtagttggtaaagttgttcacatgaaccttatttataatagtaaaacactgatttataataataaaaaatttgctatagtaacaaaaagagtctagagtaagaaactagctgagcaacgtggtgtcacactatacacccattaagacaacaggcacatgtgtcatgtccattttgtggaaaagatatgtaaaataattttaagtaaaaaagataaatataaaaaagtgaatgcatacaaaacaatttcacaaaattgaatgttactcaaaaatcacagctcattttaagctgcacaaaatagtcatttttttctttataattgctcaaattcataatcaaacagaagaaagttcctgtcttggaagtagtgctatgccccaattcttccagagccagtactttaaacaattccatttcattattttcctgtagactaattcttaggacatcagcatatctctcttcaagcattaaaaaaatctctttagagtcagtggatcaatagacagttcctgttttccacacaactgaaagggtggagcccccaaaccacaaggggaagaaggaagttaaaagatgttaaatactggggccagctcaccctggtcagcctagcactctgacctagcagtcaayatgaaggctctcattgttctggggcttgtcctcctttctgttacggtccagggcaaggtctttgaaaggtgtgagttggccagaactctgaaaagattgggaatggatggctacaggggaatcagcctagcaaactgtaagtctactctccataattccagagaattagctacgtatggaacagacactaggagagaaggaagaagaagaaggggctttgagtgaatagatgttttatttctttgtgggtttgtatacttacaatggctaaaaacatcagtttggttctttataaccagagatacccgataaaggaatacgggcatggcaggggaaaattccattctaagtaaaacaggacctgttgtactgttctagtgctaggaagtttgctgggtgcctgagattcaatggcacatgtaagctgactgaaagatacatttgaggacctggcagagctctctcaagtccttggtatgtgactccagttatttcccattttgaacttgggctctgagagcctagagtgatgcagtatttttcttgtcttcaagtcccctgccgtgatgtgggatttttatttttatttttattttattttattttatttttaaagacagtctcactgtgtggcccaggctggagtgcagtggcatgatctcagctcactgcaacctctgccttctgggctcaagtgattctcgtgcttcagccttctgagtagctgtgactacaggtgtgtaccaccacacccagctaattttttgtattttcagtasagatggggtttcaccatgttggccaagctggtcttgaactcctggcctcaaatgatctgcccacctcagcctcccaaagtggtaggattacaggtgtgaaccactgcacccagccgacatgggatttttaacagtgatgtttttaaagaatatattgaattccctacacaagagcagtaggaacctagttcccttcagtcactctttgtataggatcccagaaactcagcatgaaatgttttattatttttatctactctacttgattaactatctttcattttctcccacacaattcaagatgtgccatgaggaaaagttattttrtagtttagtacatagttgtcgatgtaataatctctgtagttttcagattgaattcagacatttcccctcaatagctatttttgaatgaatgagtgaagggatgaaatcacggaatagtcttgttttcaagattctaacttgatatccaaattcacctttagatattataagaaaatttctatcagaaaatccttatgtttttctgattaaaaaaagcatttttccatcagcctatgtatctgctatgaatttacaaaatctactcaacagctctgttgatttttctgttcttggctgaatgttgcctgagggatgggagcacgggaagggtaaaagcaatggaasaaacatgtattttaatattttaaaagtatgttatattgttcgttggtgttacaagatgatttgcattacaaaaggattctcttacaagtcccttatcttaacactaaagtgctaagatattttataagtaaatctttatacttataaaacaaatcagtaaaatagaagtagctaagtagaactgattttgctatagagtataagtcacttagtgttgctgtttattactaaaaataagttcttttcagggatgtgtttggccaaatgggagagtggttacaacacacgagctacaaactacaatgctggagacagaagcactgattatgggayatttcagatcaatagccgctacyggtgtaatsatggcaaaamcccaggagcagttaatgcctgtcatttatcctgcagtggtaagacaagctaatatttgaccaatctggttatacttacaagaattgagaytcaatacaaatgaaaaagccttgaaaggttcatgagggacctagaaaaactacatctcaacttccagaaagtcattattattttcctcataattccctgagtaagaaattaaagaagtggtatcataaaaggttgatgttttttaatatacagaagtttctggaatgacctattaatttactgtcaatggccttactgatgctttgtccagaacaatgccattgctcctgcttactttggggaggttttgggataatttagttgtatggtcctttttcaattgttttacttttttttttatgaaatgttctaaatgtatagaaaattagagacattagtataataaacagccatatgcccattatgcactttaaaagttgttaayattttgccatagttgcttcttctatgcctttttttttttttttttttttttttgctgagagttttttgtttggttttgttttgttttattttgagacagggtctccctgtccccaggctgtagtgcagtggcaccatcacagctcactgcagcctcaagtgatcatcccaccacagcctcccaagtagctgggactacaggtgtgcaccaccatgcctggcaaatttttgaaatttttagtacaggcaaattctgtgttgcccaggctggtcttgaactcctgagttcaagcaatcttcccacctcagcctccttaagtgctggaattacaggcgttagccactgtacctggctactgctgagagacttttaagtgaattaggaacatgatgatattccatttctaaattctttagtttacatcttcaaaaaatacagttcctgtagaattattattgtaaataacaaattaacttaaggatttatttatttggagtgaaacaaatattttactgaactcataaaaatagaaataccatgtggaatcctcagtgtcaaaaatattgcagaaatcttgcaaagttgatattattaaattgttaaatattaaaattcccaataaagaacattaatcttatttytaaaatccagttaattaaaaaaatttatattatataataatatttggtcattaaataaaaattagaaaatacaaataagaaaaataacacccataatcttactacccagaggtttataaccatgggtaaattctggtatatattcttccagaatgtatatcaatcatgtgtatgaatgttaaattatatcatacacatataaacccacatacaaacatgtaaatactgtgtgcttttgcaaaaattaaattgtattatacacacggctttacaatttgcttcttatcacacaaaattatttgcatgtcagcaaatacaaatcggtttttaatgatcttttgctccattttccagatgagaaaaaaatacaaatctgtatcatcattttaaaagaatgactagaattttaatatatgaatattctataatttactgatccaattgttactattgagcacttaggttgtttccatttttccctcataaattgctatgaatagctttttgtatacatctttgggtgcatttcttatttcttttggataaattttcaataatagaactgctgagtaaaatatcactaggtgtttttttacagtgtctagtgcaaagaagacctttaatcattttgttaatacttccagagcttccaatgactttggtaaatgamgaaaaaaatgcttcatttcatgctgaatgggagagaatgaagagagttttccccaacaatyacacatatatggactcatagaaaataatatcttaccattctttccacagcctaacagaaaaaagctggctaaacctaaatttaaaataaaatatctattaaagtttttattccttaccacctgtctttcagctttgctgcaagataacatcgctgatgctgtagcttgtgcaaagagggttgtccgtgatccacaaggcattagagcatggtatgttttaagtgttaaaagggaaaactatcttactctactgttgatatatacaatgagagcagacttttaaagaccaaagtatgctaatgacacctcaaaattgcagcttttggcttatgctaaatgatgtattacctacatccttgaagaaacaatctactttaactgatccagaatcttactcttttactcctcaatttattttaggggatttctagagttttaagatgcttcacactctatcagttccttgtcatatcttgaaattctttttagaataagtaagtgtgggccgggcacagtggctcaygcctgtaatcccagcactttgggagaccgaggcagatggatcacctgaggtcaggagttcgagaccagcctgcctaacatggcaaaaccccatctccactaaaaatacaaaaaattagctgggtgtggtggcaggtgcctgtaatcccagccactcgggaggctgaggcaggagacttgcttgaacccgggaggtggaggttgcagaggattgcgccattgtacttcagcctgggcgacagagtgagactctgtctcaaataaatacataaaaaataaacgtggaattcactttgcagttgctgctgtacaacgcacattactcaatctttatgttcggcattctatgctctactgagaaatttgggtaggagtgaagtattttgtatacatatcttcatttaataaatagcaatagctgggtctatcttactattttatctattgataaaatattttgtttccccaaggagtgcgaagtatgtatattacaatgaagatatgttttaacctttcaccatttgcttcatctttttctacagggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttayattaagcctacaacatttttyagtttgcaaatagaactaatactggtgaaaatttacctaaaaccttggttatcaaatacatctccagtacattccgttctttttttttttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaakgttatcttaaatagatcttaggcaaaataccagctgatgaaggcatctgatgccttcatctgttcagtcatctccaaaamcagtaaaaataaccaytttttgttgggcaatatgaaatttttaaaggagtagaataccaaatgatagaaacagactgcctgaattgagaattttgatttyttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacatgccttgtctgtttttatttagactcctatagtgtctctgaagaaaagaatacagatatttgaaaaaatatgatttggtgctcttaatatctcttatatcgtcacttacctcacttaaatagtcagatattgctggagaaaaattcacaagcatgctgacaggtctcactttaaattcataaccataaatctcaaatgagccctcaagtctgcctgaccattttagttacttctctacaatccttccatttttatgtccctagtctccaaaatgactgttactattttacttttcctcttctctcttcaaagcctcaagacacacattcagcctcctcctctgcccccttatcctccaccctcctctgctctcagcagataacctggcctcatattacacttctaaaacaaaagcaacttcataccaagctttcccttctacatcccaaagcagcagtcataccttcccacaggcccatccttccttccttccctcctattatcaggatgaagagcctctgctcctgccaacagcactgactccacatgcagtttccctcccatccctctcactactccaagtcaggctgtttcctgcatccctagtttgtcccttttagctggatcacctccatcattctacagtctgccctagtaaccttccatcttacaacaaatactccactgaccctacataatcctccaactgcaactccattctctgctccctttacagcaagacttctggggaagtatgtctgtacttaccaactccatgacctcacctcccagtgtcttttcaaccctctctaatctggcttctatcctcacccagctgaaactgctcctccaggatttctcccatgattcctcagtgctaattccagtgatcatcttgttcatctcagcagcatttgacaaagtgaaccgcttcatacttttagcagttttttaatcccttggcttttccttatttacatcctacctcactgactgttctttctcagtccttcttgctcactctttctctgctatttaatttctaaatgtgagagtgcctcagggctcaagtctataataattttatatactacatattttacttatttgtctcttctcaccaaaatataacttccaaaatgacagaggtttttccactttttaaaaaaacattgaaataaactcaatcttttaaaaaatataaaagtactgtacaaagatcttttatttttcagaactgttttgagagtaaatagccaacatgatacccaatggccctgattacatcagtgtgtaattcctataaagacattctcctgcataaaacctcaaaacaattatccaaattaggaaattaacactgatacattactaccacctagtcatcagattccactcaatttcatcgattgtcccaataagaccttcataacaaaagcatctaattcagaatcatattgtatttggttgtcatgttttttaagtctctttgaatctggattatttcctcagttgtttctttctggactttttatgaccttgccacttttgaagaccacagactagttatgttatagaatgtacctaaggtttttctggtgttctctcgattccattaagttatgcatctttggtaggaataccacagaagtgatgttctcactgcatcctttcaggtggcattcagtttttgcagttttgatttgccccattattgatgatgttcacttggatcacttgattaaggtgaggcctgcaagccatcttcactgtaaagtatttggggaggaggtgccttgagactactgctcatcaaattttcagtttgtttgtttatttatttagaggcaggatttcactctgtcgcctaggctggagtgcagtggcgcgatctcagctcactgcaacctctgcctcccaggctyatgcaatcctcccgcgtcagcctcctgagtagctgggactactcgcacgcgttaccatgcctggctaatttttgtatttttagtagagatggggttttgccatgttgcccaggcttgtctggaactcctgagctcaagcaatctgcctgccttggcctcccaggtgctggattacaggtgtgaaccaccgtgcctggtcatgcatttatttattatatcagtatggacccatggcttctattttattcaaatcataaggagttatagtccattactattatttattttgatgttcacactgtcctcgatttggccagtgagcccctgcaagttgtcttctgtgccatttcgacatatttccatcattcttcaagcactttcttgttttctggcacaagatattctaaggctcaccttgttccttccttgcttccaaaaatggaaaaggcatttctccaaggagccctgattcctcaaagtgcataatagtattaaaaaaacaggatctgggcactagggtatcactgtttccaggccctatcagtgaacagagctggaagatatatgtatttacactatatttatctctatatctatctatttatattgaaaatcatgaatccacaccaatatctccaattctaatctcacaccacaggattcactctagttttcttctttcgcatgttttaactctcttctctgacagtaagtaacttagcatccattatactcattatccttaaaatgtatccttagtacatttacgtatttgatgggtttgcctgtatgtaaccaattccccaactctgcccaagtgctctccactcaggctctgacatccctcagtgggttgcttccttccccaacacctggacaccctccttaccatgatacatctctgattttataatatgctgaaccactgtcctgataggaagaatagaaatttttcactcattccacttctgtattctaaacacctagaagagtgactggaacatggtacatgctcaatcaatatcagttgatcgaataaatctcttgctgattatttagtatgttccctccaaactgaacattctaagctttttgtttttgagacggagtctcgctctgtcacccaggctggactgcagtggcgcgatctcagctcactgcaacgtccgcctcctgggttcaagcgattctcctgcctcagcctcccgagtagttgggactacaggtactcgccaccacgcctagctcatttttgtatttttagtagagagggggtttcaccatgtcaggagatcgatctcctgacctcgtaatccgcccgccttggcctcccaaagtgctgggattacaggcgcgagccaccgcgcccagcctttttttttttttttttttttttttaattaactcttcaaggccacatgattccagtacaaccgcttgcggggttccaagccacttcttggctatgtaaatgcagcacatagactagccatgtgagggcagcagagggccactacataggtgcaacctttggcttcaaaattcttggaccattctgacgtgattaaactaaaaacgaatgagtttatgcatatcgagataccctgaggtgtacaaaggatgagtcaaggtagcggagagagagttgaagagtgacagctgagaaacagagataggacatgtccaagaagtgccaggataacccaacaacacaggctgattgaggaaactgccagagattagacaaagtagactgaagagggaaagcaatgtttgttggagattttgctttagtttttgataaatatttcttagtcataccaattgttttaaatataattacgcccccaaaccaaatttctactcttattctggcaacagaataaaaatcaatatcaatgtttgatcattttcaaagaaactcagttcctatcttggttgaaatgcagtgacatccatatgacaattgagctcttcatgtggcactaatataactaagccctgagcacatcccttgcacttctatttagtgaagtcttttaaaaagtattttctttacagttgttaagtggaattactaaaaattacaatcagcagtattttctactcttttagcttattttttaaaatatttatctccatgcttttcaatattacacctatattgcttcttcttgatttttccattttaagatactgacttcctactatggaagttaaagattaagctctatttcctcctcctccatccccatcaagcatagtacccttctccaaagcccatccttctaaatgtaattctttttttgagggggaggggggatcaatactcagtttttttttgttttgttttttttttttttttgagacggagtcttgctctgtcacccaggctggagtgcagtggtgcgatctcggctcaaggcaagctccgcctcccgggttcacgccattcttctgcctcagcctcccaagcagctgggactacaggcgcccaccaccacgctcggctaatttttttgtatttttagtagagacgggttttcaccgtgttagccaggatggtctcgatctcctgacctcgtgatccgcccaccttggcctcccaaagtgctgggattacaggcgtgagccaccgcgcccggccaatactcagtatttatgtaacaataaatacaattactttcctttcttgcacaagattttgttttccctagaattaatagctgcataattcttacagccgcttagttttctgtgtacctgtcatgagttaaactccaaactctcggtcaaatctcctcttgattcaacgccagctggaattttgtcaatcccatccttctgaagcagtgtctcccaaagatttctgaccgaatctaatctagatgcgttgccgtctatgcctatacacagctattgttcccggagctctttcagtatcatcttgggatcttactattttctgtgtttgttatttattgtatttcctgcatttcataatttcctccttcttggcttattccctcattttggtggatcagatctacaggatcttcctggaggtactgagaaaggtaagataggtactattttttgtgtgtagtgatttagcacatctgaaactctattctattcacacactagattggtagttggatgagtattgaagactaaatcggaagtaattttccctcagagttttgaagacagtgccgtatggcttcctagattctaactgagcaatctgaagccactctgattctatagtctgtataacctggaagggtgtgggatctctttttcctcgatgttcagaaaattcacaatgatatgccttgacgtggatgctttaatatttgtgctgggtgcttagtaggatctttcagtgtggaaactcatctccttaacatctggacaactttctgaagtcatttattatttcctgcctttcattttttttttggtttggaactcctgaactggtcctgtgatgtgactgcagccgccaggcgcgtgcgcagtgtacactgcgtgcgcatacgcgagcccgttgcgcctgcgcgcggtgccgccgtcgcccctcttttmgcggcgttctccacctgcgcgggcctgaatggccttcaggagcacagtcggcctgaggagttgatggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccagggtggctctcccgccccggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccatccr

SEQ ID NO: 17708 - DNA, 148935 bp, Homo sapiens
caagtgaaaggaagagttgcatatctctcattttaaatcaaaagctatactttggccaatttaagaaacaaaaaaattaaaagctagaaatgattaagcttagtgaggaaggcatgtcaaaagctcagataaggggccaggtgcggtggctcacgcctgtaatcctagcactttgggaggccaaggcgggcagattgcctgagctcaggaattcaagaccagcctgggcaacatgtgaaactccgtctctactaaaatacaaaagaaattagctgggcgtggcggtgtgcacctgtagtcccagctacttgggaggcaaaggcaggagaattgcttgaacccgggaggcagaggttgcagtgagccaagattgcaccattgcactccagcctgagcgacagagcgagactccatctctacaaaaaaaaaaaaaaaaaaagctaagataagctgaaaaccaggcctcttgtgccaaacagttggccaagttgtgaaggcaaaggaaaagttactgaagaaaattaaaggtgctactccagtgaacatgtgaatgatgagtgaaacagccttagtgtggatatggagaaagtttgagtggtctggatagaagatcaaaccagacacagcattcccttaagtcaaagcctaatccacagcaggaccctaactctcttcaattctgtgaaggctgagagatatgaggaagttacagaagaaaagtttgagatagcaggatttggttcatgaggtttaaggacaaaagccatctccataacataaaagtgcaaggtgaagctgcaagcgctaatgtagaagctggagcaagttatccagaagatctacttaagatcagtgatgaaggtggctacatgatacaacagattttcagtgtagatgaaacagccttctattagaagaacatgccatccaagacattcacaactacagagaagtcaatgacaggcttcaaagcttcaagagacaggctcaccctcttattaggggatattgcagttagtgactttaagttgaatccaatgctcatttaccattctcaaattcctagggcccttaagaatgatgttaaatctactctgccagtggaaaaagcaagagaaccagaactggaagtggggtctgaagatggaactgaattgctgcaatctcatgagaaaacttgaacagataaggaattgtttcttatggatgagcaaagaaggtggtttcttgagatggaatctattcctgggaaagacactgtgcacactgttgaaatgacaacaaaagattgagaatattatataacttagttgataaaccagtgtgagaggtctaatgtgggtaaacactattaaacagcaatgagaaagaacagaaccagaatagtggctctacattacacgcatggcttccatgttgaaagacagtgagacatggctgggcgcagtggctcatgcctgtaataccggcatttagggaggccaaggtgggcagatcacttgaggtcaggagtttgagactagcctggccaacatggtgaaactctgtctctactaaacatacaaaaattagccgggcatggtggcaggtatctgtaattctagctactcaggaggctgagacaggagaaccacttgaacctgacaggcagaagttagagtgagccaagatcacgccattgcactccagcctgggggatagagtgagactcgtctccaaaaataaaaaataaaaaatagaaaaagaaagtgagatataaaggaaacaataacatatgttttttgtttacgtaaaatccaaaaatggatgaaaagaattcatggtagttttttccatatcagctaggtaatgtgccaacatcatagcaaagtttgaggaaggcacaggtcatacatgagcatgaaaacccaatcattatgcctatgaactacaaaagaatcaaagaatctgtggttttaaaaatcagaatagccaggcacggtggctcacacagcactttgggaggctgaggcaggtggatcacgtaaggtcaggagttcgagaccagcctaacatggtgaaagcccgtctctactaaaaatacaaaaattatctgggtgtggtgacgggcgcctgtaatcccagctactccggaggctgaggtaggagaattgcttgaacccaggcggtagaggttgcagtgagctgagatcgcgccatcacactccagcctaggcaacagagtgagacttcatctccaaaaaaataaataaataaataactaaatatatatatatatatatatatatatggaatataattttgtatttaaaatgtacaatacaatttatacttacacgtatcatcttaccacttgctttttttgcttaatattttattttaaaatttattcacattatttccccagttattaagggtgaaaaacttagagcatgaaaaaccaatatgtacttacaataaactgattttcaagttggcaatattatttgcagtggtaaaacctgcatcattgagggtttcccacttcaggattaaattgtgccaatcagccgcattgtccttaatttttcttgcactgacagataagacaggttttctgggcgttacagttccaagagtctttgctgatagggtataaaagaaacaaaattattatcatggaatatacaatcatagttggagggcaaatgtccttataattttcaacagtaaaactatctgaaatgctgtatcaactggacaaataaatgtggaaactacaaagtctgaatgaatgtgaaagttcctggaagaagacaatatagaatatttttaacattttaaaattcaccagatagagctgaatcctcttccagcttaatggctccacaaagtttttaccttaagccctttgttttccaaagattggaaataaggtaaagttgtgactgtctgctaaaactcttcaatggctcacgttcccttccctacaggataatctagccctgactcccgagtacttccactatctagtctcaggcactctgatactttaaatttgctcagagtagcgtggcccatgagtgctaatcatttcaagacactgagacaacagagatgcagagttgatcacgatgctgccactgcccttcttggtaatcaggaggaagtccaaaatccttccagacctagctacccctccacatcatcacgtacatcaacccacaccttggccccccgtcaatatccagcgaaaatgaactactggcagctcttgaaaagctgaggtgcctgcaggcctttacacgtgttctctctgcaggaaagctccttccttcctcaggctcacgatgcccatcctccaagatgcacccggatcccactgcctgtaggaagcaacccccagaccaccaagagccaactcaggttgtttgttctccccgaaccctcctgtgccctcttgccttctctactttgaaccccacaaaggcttctcactgcccacaggataaagtcctcttgaggaatccaggacacacaacagctggatggtttgatgcctcaagtcagaagaccacactgcctgcgtctgaaccccagctcgccagctgtgagatcttgggcaacttaatgtacctttcagagcctcaacattttcatctgtaaaatgggaataaaaatagtatctatttcataggattgctgagattagataatatatgtgaagctgtgaggcctcgcacaaggcaaaaacccagtatctcacctgttagctcaagggcctctactatccaagctctgcccaccacttcagcttctaccctttcccacttgccctctgtgcatcagagctggctctgtacaagttctgactttgacctggaatatttttcctatctgtgtgtgtccccactcccctgcctcatacttagtatcctcactttaaaatatcatcttgatttatcattcattctttacttaaacaacaaatatttgcttactgcctacaatacgccaggcatgggggaatgaagtgattgaatgagacggaccaggaccgttttcatggaacttactttccaaaggggaggcagataataaacaaatgaccacgatcagttcagatcatgattaagtgtgtgtggaaaataaaacagggtcttgtgttagtgtgatcccctgagaaggtgtcgtttaggctgagatttgaatgatgaaaagccagaaatagggtaggtcagtagtatgtgccctaattatgataatgaggttggtgagttcaaaaaacagaaaacaaaacaaaacaaacaagcaaacaaaaaaaccagtgtgctggaatgaaatagacagaaaaggactagtgygtgagtaggtgatcagacaactagaacctaataggccaagataagaagttggaccgagggcagtggctcacgcctgtaatcccagcacttcaggaggccaaggcgggcggatcacgaggtcaggagatcgagaccatcctggctaacacagtgaaacctcatctctactaaaaaaatacaaaaaatcagccgggcgtggtggcgggcgcctgtagtcccagctactcaggaggctgaggcaggagaatggcgtgaacccgggaggcggaacttgcagtgagcccagatcgcgccactgcactccagcctgggtgacagagcgagactccgtctcaaaaacaaaacaaaacaaaacaaaacaaaacaaaataaaaaaatgaagtttggacttctaagtattagcttggtgcaaaagtaacagattttgccattacttttaacagccaaaattgccattacttttgcaccaacctaatacaatggggagtgagcaatgagctctggatagggcagtgaaattatctgatttaggtttttagaaagtcatttccacagagaagtattcctggatcccccaggttgggttacgactcaccactagatatgtggtacaccctataattctgctatcatgatattcaccagtggagtgtatttgcttgtttaatgtctatattccctgctaaactggaaattcgactagggtaggaactatgtctcgttctctttcaaaccttccacacataggaggctttgcataaaatgaggtaaatggaggaatagctcttaccacctgttctataattgtctaagggttttccccccaacaggagattctgagggcaggatcacatctgattcatggtcagcctgactcatacggggcacatatttaggaaccaaaaacataactgacttcaagaaactcaagggctggtaaagacagaccagtcatcagcgtcacaggacagggtagggtgagggcacagtggctaagttacttatcccctctgagcctcgattccccatctgcaaaatggggttgacattacttcatgggaccactgtgaggttcaaatgagatgatccacttaaagtgcttggagcagtactcagcaaactgagcactaggcgaaagccagctttcattacaagcagaatgttctgactgagggcagttcagagaggagtttctggacgagatgagcatgcaaggcttggtacccagtgaactctgttagtactaatttatagtgacaataattacaatttggatgtcggatctgctgacactcatttgcgtatatcgtcccgttcatctgtcactgcacatgtgaaaaaacggaggctcggcaaaactgtctcccgagcagctcgcagaggctgcgaggggcctgcgggctaggctggggtaagacagaggacctccatttaacctcatgtaatccggggagctcctgagcttctggtccaacctgcggcctaagcagtaacattcacagccaccccaccccgggaaaggaaccgatctcacgcaccttccataaggtccacagatatccgtagaaggagacgcgaagccccgcccaccccaccggaaacgcatttgcgtcacgtccgccccgcccgctgccacttgtggctctgccgctctagcccccggcggagccagctgctgctcttcggtgctggccccggtgccggccccgttgcccagggaacaggctcccggcagcccccgcggcccggagtccatcccgcctcctccggcccggcggggccgacgagtccggaggggctgccgcgggaggtgagtccggcgacgccgcaagcggccccgacgcccccgacgcccccgacgcctggccccgagcccctcctcggcctcccccgggccactcttcccttgcctcagccccgcagggtctccatgcccgtccgccccgtctccctcgcccgcggtctcgcccgcgcggagtggcggacactaaatgccacaacacacggagcgcctggctcgccgcccgcagaatccggcggtccgcagcggggaacaggggccgcccgcccctcctcaggcctccgctgcgcgtcccgcgccctcggcccccggccccaccctgcatcccggctgccggtctggccgcgggctctgctccttcgccttaagattgacgtcgtgttctgtcccccactcgcagcccgcgtcccttacatccgcccaccggcgcctggccccaggccttgacactcatccagttggtgttcagtgttcgatgagtggataagtgaatgactcctttcccaatcctatttgaaggcatgggaggcagaataggtagtaagtgttaaaggatggggtgtcctggagtcagagccgggcaggtcccagcggccccttcctagctctgtgctggggcaagtgccctacctcactccgctccagtttcatcaccagtggaatggagatgagaatagtttctacctctggcttggtaagaggattaaatgggtcagtgcatgtaaagttargcacggtgcctgccgctgtacatttcagtaaaggggagcccctgctgtcatctgtgctagcctgcgttctcgccctctagtyccttctgatatgtctctgacttctcatgactttagtttctccttctctacctccatttctcttccctgcacttttttcttcctctcttattgggattcaggaattttattctgttctgtgacttatgttccatgtgttggcagaatgtgggataccagcctgggtgcatccttttctcatctattggagtgaccagttgcacttgtggactgcctccttgcagccaaggtcttgtagacagagttctgggaaatctcaaaacgcaaatcccaggcataggtagaatctgggaatgaagccactgtagctccttgtgatcaccagcgattcctggtcttttaggctgcaggactttgtgttttctcacacccagctataatgtaccttgataaacctctgaccttatttttgttgttgttgttgttaacctgacttacgtcccatattggtggttatttggccatcgtgtgccagcactgtgccaggctggctctagggatgctgtggtgaaccagacagacccttcctgaggtcactgcctcagaaagatcatggtctggcccatgaactttaaaagggagaactaagtgcaggtgtaggggacacacaaattgaattttcaggactgccttggaaaaccagtggtggggaagatggaatgaggataaccctcttctgaaggagtgactaggaagtagcttttgttaggcatcagctatattatacccacgtgtctttttcaatagaagactggcatctactggatttttttttccaattttttcttaaagaagttacacttaagtttggggagaatttcatttcatattagccgctgtaggagttgaaaaaaatggctactggaacttagtgggaagaaaaggaaggaaacaggcatcaggcagaggcagttgattgaacttgggaagatgaggaatagatcaggaaagggttataatgaaaagctttggtgtcaagcacgaagagatttctagattcagtaatgcacagagagatcagtaaaattagaagggagtagttgatggctttgcgaattgctaaggtagaagggagctgttactcaagatgcatgttcaatttaaaatgaatgtattctttggacctggacataagagttctattgactttttgccactattttatatttagggctgtcatacttgggtgaatctagcacagtgctttgagagagagattcattcaacaaacgtgtattgagcattgattgtaccatactctttattggtcttttaaagcaccacaaagtatacagactagaagaacataggtgaagatgagaaagagtccattgaaggggagagaaaacagataatgatggtgctgtgcgataactgccatcatggagttctgtgaaagcagagaaagaccaaccaagtatctgagggaatttatgaaggcttcctggtggcggaggactagttcttacagggcacatgtgggggaatagggaagagtggaaagggactttgttctgcagagacatacaggttatggtgtgtgcagggactgtgatggaargctgatggatgcacaaacaaaacgtggcctgtctacacaatggaaggctgttcagcaataaaaaggaacgaagtactgatttgtgctacaacatggaggaaccttgagaacattaggctaagtgaaagcaaccagacacaaaataccacatattatatgattcaattttratgaaatctccagaataggcgaactgtagacagagaggagatcagtggttgcccagggctgagagaagaagcgtgtagaggggtgattgctaaagggtagggagtgcacagtgtgtggatggaagagtggcctgagatgaagttagatatagactgttttgtcatagtgtctaatttccatgcttgtgttaggctttagcttgtgaccattgggtagccaatggggatgggagcaaggaagtgacaaaattttgtctggaagataaatgactgcctcagtctcattacgttcctccttaataatttaatactcaaataattaatagatgtcgtagccagatttcaaacatagattctacaatagggatacaaattgttgcttcctagggattttggagagaatcctgaaaccattagtgtacccagagcactctgataacatggttattgtacagcgaagtggatgacttagactctatattagtcctagctccagtttgagaaatcatccatctgggtggcagttgggtgttagtagtcagcagtgaaggctagctgccaccttccagggttatgagattgacagggctagtggggaaaggaagcatcgtaacttgaaggatgccatagggtggtgttttgtatttttttaactgaaatagtcatgactaaggaagcattattcattatatttttatttatttatttatttttgagatgaaatatcactctgtcacccaggctggagtgcagtggcacgatcttggttcactgcagcctccacctcccaggttcaagtgattctcctgcctcagcctcccaagtagctgggattacaggtgtgcgccaccacacctggctaatttttgtattttttagtagagatgggtttcgccatgttggccagactggtctcgaactcctggcctcaagcaatcctcccacctcggcctcccaaagtgctgggattacaggcgtgagccatcatgcccagcccaattttaaaaattggattgagactattgttttgcagtaagacctgaagttaacaaatctttactgagcatctactctgtgccaaagctattattagatactaggatttaccttggtaagcaagagagaattcatgttgcttacattcttgtaggagagatgatttttaaatggtttagcaaataaagcaattagaggttgtaatgaggattatgaagcacatatgatagaggaaagaagggacagttgggtactcttgagtgatctggtcagagaaggcctttctgtggtggtgatatttaagctgagaccccacagttgagaagaagccagataaatggagtgagatcatttattctgcatagaggaaataattatgacacctgagtgggacagagtgggtcagtggagctagaacttggaggacaagtggagacgggtagagaggtgacaggggagctgcaaagggcttagaccacacggggcatttggtttttattcttagagcactgggcaaccagtgaggagttttgagtagaatgggtagtatggtctgatttctctttgaaggagctgatattttcctttgttttttggggggtaacagctttattgagatataatttacatgccacacagttcacccatttatatacaattcaatggtttttactgtattcacagctatgcaaccgtcactacgtcaattttagaactttctcatcaccctaaaaggaaactccgtacccttcagcaatacaccctaaccccttcttctcccagccctgggcaaccactgacctactctgcctacagcttgcctattctagacattttgtatacatggaatcatataatatatggtgttttgtgcctggttgctttcacttagcataatattctcaggattcctccgtgttgtagcatgaatcagtacttcattcctttttattgctgaacaggcttccattgtgtggatagatcacattttgtttgtccattcatcagttgatggacagttaggttgttttgacattttggctattatgagtggtgatattatgaacatttatctacaaattctttgtagatatgttatcatttctattgggcataaacctaggaatagaacttctgggtcacatggtaactctgtaaccttttgaagaactgcccactggtggctgcaccattttatttttcaccagcaatgtatacagttttttccacatccttgctaacacttgttcataccctagtgggtatgaagtggtatctccttgtggtttcgatttgcatttccctgatgagtaatggtgctgaacatctttttatgtgcttattggccttttttttttttttttttttttttttttttggaaataaagtctcgctctgttgcccaggctggagtgcagtggtgcgatcttggctcactacaacctccacctctcgggttcaggtgattcttgttccttcggcctcctgagtagctgggattacagatgtgcgccactatgcccacctaatttttgtgtttttggtagagacagggtttcaccatgttggccaggctggtcttgaactcccaacctcaggtgagccacctgcgttggcctcccaaagtgctgggattacagatgtgagccaccgtgcctggccttactgggcatttgtgtgtcttctttggagaaatgtttcttagactttgcccattgtaaaattgtcttttgttgttgttttgagatgaagtcttgctgtgttgatcaggctggtctcaaattcctgggttcaakcgatcttcccaccccagcctcccaagtagctgagactatagccacgtgccactgcacccagcttttaaaattgtctttttattattgagttataagagctctttatatattctgggtaaaatctctttatcagatatataaccaggagatattttcttccattttgtgggttttttttttttatttttgtcggtggtgtggattagatgtatttttactttcttgatggtgccctttggagcacaagcgtttttcatttcagtgaagtcaaagagctaattttgatggctgaatgagcctggcttctgggggcaggtgtggaagaccatggcagcagtgtaggcgagggatatgatagcttgtactgtggcatggccacagagttggtgaggaggcgccaggcttgagggaggcttggagatagggctgatggactgagttgagagattgttgtacgggtgagggaaacagaggaattgagggtgaatactaggatttcagcttgaacaacacttttgattcaaaatgtgattatgctgttacctgccggacaattgtgacagtttctaatacctgctggagcctagcaagggcagccctgcgctccctccctgggttctgaagttgcttttggtaggattatcactgagtgtgccaaggagatggtcagggattctgaccttttgtaatacccactaagacctcctaagccaccacaaataaacatattatctgagtagaatagtgcacttgctctgcaaatgcacttttgaggcaaatctcttgactcccttctagctagactgcagtctcaaagcccttcttgtgtagagcytgcgagctgtcagtggatagcatcaaatcaagcggatggattcttgaaagctaaatgtcatcatttgacagagctactatgaggaaaaatatttttatttttaaaaaagttttattgatcgattgatttgagatggggtcttgctctgtcacytaggctggagtgcagtggcttgatcatggctcactgcagcctcgaactcccgggctcaatggatcctccaggttcagtcgatcctccgggctcaattgattcttgtgcctcagcctcctgagtagatggtactacaggcacgcaccaccacacctggctacttttttgtattttttgtagagacagagttttgtcatgttgcccaggctgatgtcaaacccctgggctcggccaagtgcagtggctcacgcctgtaatcccagcactttgggaggccgaggcgggtggatcacaagatcaggagattgagaccatcctggctaacacggtgaaaccccgtctctactaaaaaaaacaaaaaaacaaaaaaacaaaaaattagccaggcgtggtggcaggtgcctgtagtcccagctactcaggaggctgaggcagaatggcatgaacccgggaggcggagcttgcagtgagccgagatcgcatcactgtactccagcctgggcgacagagtgagactctgtctcaaaaaaataaataaacaaacaagcaaacaaacaaacccttgggctcaagtgatctgcccacctcaacctcccaaagtactgggattacagatgtgagccactgtgcctggctgaggaataacttttttttttttgagacagagtttcgctcttgttgcccaggctggagtgcaatggcacaatcttggttcactggaacctctgcctcctgggttcaagcgattctcctgcctcagcctcctgagtagctgagattacgggcacctcccaccatgcccagctaatttttgtgttttaatagagatgaggtttcaccaagttggtcatgctggtctcaaactcctgacctcaggtgatccacccacctcaggctcccaaagtgctgggattacacgcgtgaaccaccacacccggccggtaataagatttttaaaggaggaaataacattaggcaatacttactggtgaagagctcagtacttccgcttgcttgctaggagatctcatgagctaaagcagatacgaaagtgcctgccagagatagggagtagaaggtgtgaaggccaggacgtgagaggccaggcctgttgtaattagaagcaattcagtgtggctggaggacaagtgagagatcctcgggtggcagaggccagatcaccaaggttcttgtaagccagcaacacttgggctttagcaggaggaagatggggaccactgcagagtgttaagcaagggagtgatgacatcagctttgcacatcaggaaaatccctctgtttgccacgtggatgacggggagggagaggcgggcagatgagctgggcaccagagagagctgcaggtgagaggtaatggtggcccgagctaggggtgacacactgaggtgtgtgggagatgtactgaatggagaatcggggacatggagaggagaggaggagggatcagggatgatgctccttttctggcttggtcagcatggcccaggcaactggtagaagatacaagataggtaagtgtctttgacattgttcatttactctgtgtttatagctaggatgtaagttttactaatcccatttcagatggtaattggagatctagagaggttgagcagttattccagggtgcctcaggtagttttaggagcattgggatttgaacttgggtctttttcacttcagtatcattagccactcattgtgcagttcttcctcggtggaaagagggtcagttctgtggctgtgggtctgagacctgggggttgggtgaggtggaacatggagttgggtgaacattgggtaaggaggaggagcagaaagtcttagcagaaatgtttgctgtgtctgcattgtttttcccaaacctagcgcaggacagtgagacagcggctctatgccttttcctcagcccgtcctagacactgtttctgccaggaggacagttttgctgggagttggcctcaacctgctcctcctatctgaatggtgggtgaaggacagacaagcctggtgctaagctcatccagaggcccccagatagggaaatagcatggattctcttctgcccgctggggacttcttgggcacctggcccccaggcatggctgtcctgactcatctgggtgctatggcttacgggcctctagatatcctttggaaaaacgtgtgaggcataaattgatatgaacattcttcaaggcagtttggcaatacatttttttttaattcaacatttccacctcttgcagtgtactccaagaatatacttggatatatttctgttgtttttgatggcaaaattaaaatcttttggttgagaaaattttggtttatccatacagtgtgttctctgcagtttttctgtatagtcactaaaaatcacattctaggggaatatttaatgacatggaaaatactcatgatttattaagtgaaaaagtctgtgtgtgtgcatatatgtttatatacatatatctgtagctatctgtgtacatggcatatctcagtatgatgagattgtgacttttctttacttctttgtccttttattttgagatagggtctcactctgtcacccaggctggagtacagtggtataatcagctcactgcagccttgatctcctgggctcaagcgattctctgtgtaccaccacacctggctaatttttgtattttttgcagagtcaggatcttgccatgtttcccaggctggtctcaaatttctggcctcaagtgatctacccaccttggcctcccaaagtgctaggattacaggtgtgacctactgcacccagctgcctttgtacttttcttttcttttttttttttgagattgagtttcactcttgttgcccaggctggagtgcaatggcacaatcttggctcaccacaacctctgccttctgggttcaagcgattctcctgcctcagcctcccaagtggctgggattacaggcatgcgccaccacgcccaggtaattttgtatttttagtagagatggggtttttccatgttggtcaggctggttttgaactcccaacctcaggtgatccgccctgactcagtctcctgaagtgctggggtttacaggtgtgagacaccgcgcccagccttctttgtgcttttctatattaacaaatttttgaggccgggcatggtggttcacacctgtaatcccagcaagtctgggcgtggtagctcaagcctgtaatcctagcactttgggaggccaaggtgggtggatcacctgagatcaggagttcaagaccagcatgatcaacatggtgaaaccccatctctattaaaaatacaaaaattagccaggcctggtggcaggcacctgtaatcccagctactcgggaggctgaggcacaagaatcacttgaacccaggaggcggaggttgcagtgagccaagatcatgccactgcactccagcatgggcgacggagcaagtctcaaaaaaaaaagcaactttttgatagtgagcatttataactgttataaaaagaaacctttatttttaaaaagttaaataaattatggcacatcaatgtgtgtatgagtatgtatgtatgcactctttaaggaaacaaagccttttactatttctgtgccttggaaagaagaataagaagtttctgcatccatgaagtggaggtaacattcatgtctaatgtttggggattgcaggaaaaaaaaatggaagtaactatgatgcctacttcatgtttgttttttttttctytctttttggtgaggatttaatgggtttgtgtgctaagaacagtttgtattaagtacagacggttttcaacttacagagtttcaacttactattttttgactttaagattgagygaaaacgataccattcagtagaaactgtatttccagtaaccatacaaccattctgtttttcactttcaatatggtattaaataaattacatgagatatgcaacactttgtgataaaataggctttgattagatgattttgcccagctgtaggctaacataagtattctaagcacatttaagttaggctaggctaagctaagatgttcggcaggttaggtgtattaaatgtattgtgacttatcttttcagcttatgacggttttattgggacataaccccattgtaagttgaggagcatctgtaaaaacattagctattcccattattattactgcaaaagagggtggattgggttcttaagtatcacagaggaatgcaattattattattattgttatttacttacctttaagaaagttctcatacgtggatatgttctgcctgtattggctattgtgactgtcagatgaaatgggaatctaaggctgggcgcgatggctcacacctgtaatcccagcactttgggagactcagatgggcagatcatgaggtcaggagttcgagaccagcctggccaatatggggaaacccccatctctactaaaaaatataaaaattatccgggcttggtggcacacgcctgtagtcccacctactcgggaggctgaggcagaagaacccaggaggcgagtgttgcagtgagccgagatcgcaccaccgcactccagcttgggggacagagcgagattctgtctcaaaaaaaaaaaaaaaaaagaaaagaaatagaatctaaaaatgcttggaaaactggatatgctatacagatttagggaattattattccagcattgaattggggtcatattgaagaaaaaatgatactttgctgctcttccattccattttttagaattttatatttaatattttttcttttgctctacacattcagagaaacttctctagtaatgaactatagaaatgatcccagaaagcacagcctttgttcttctgttcttgtcactcattccttccttgcatattttccttttatttatttattcatttaagagacagtgtctcactctgtcactcgggctagagtgcagtgacacagtcatagctcactgcagcctcaaattcctaggctcaagtgatcttcctggctgagtgcagtggctcatacctgtaatcccagcacttggggaagctgaggaggaaggatcacttgagcccaggagttggagaccagcctaggcaacatagtgaaaccctctctattttttaaaatgaaatatttgttttaaaagcgtgatcttcccacctcagcctcatgagtagctaggactacaggcatgtagcaccatgcctgactaatttttaaaaatattttttgttgaggcgggagtcttgctatgttgcccaggctggttgtgaactcctggtctcaagcagttctcccaccttggcctcccaaagcactaggattacaggcataagccactgttcctgggccaaattttctgtttcatcattcattcatttatgcaacaaatacttgctgaatgcctctgatgtgcctagcccttttctccctgcggggggaagaggggtgagtgaggcagatatgggctctgctgttatgggccttacagactagtgtgtgtgtcagagtggcaggcaggcagataaccagtcagagaaaagaaaggagatgtgtggataggccggacacggtggctcacacctgtaatccaagcactttgggaggctgagatgggaggatctcttgagcccaggagcttgaggctgtagtaagccatgattgagaccagcctgggcaacacagcgagacctcatctctacaaaataatttaaaaattagccaggcatggtggcatattcctgtagtcccagctacgtgggaggtggaggcaggaggttcacttgagcccaggagtttgaggcgtcagtgagtcatgatcttgctactgctttccagcctgggtcacagagtgagactgtgtctcaaaaaaaaagaagaaaggggctgtgtagagaaagtaaaactgggagaggtgacagagagagaactcagtagggggaggagaaatcaagtacggcctcatgaaagagggcacaattgagaaggaggaagagctcagtagagaaagaacattccaagtggacggaacagccaatgcaagggccctggggtgagaacgagctggattaatttgatcagaagagggactggaagttggtcagtccactatgtagaaatagaaaacctacagttcaaagagaccataaatccatgatgcaagaagtttctgtgagaggagcttggaagtctccatagaacctgtagagctaaaatatccctccaggtgtaatcaggtacagagcatctacctggactgttacagcctgcctgtcagagctgtgactgtgctgttgtcaagagcctaggacttggagggaaaagacctagagtcaagtctcggctgtttgatcttgagtgagtctcatgaccctctggcccccagtcccttctaaaagttagggatgatgctacctgccttataaggtagggtcaggattaaatcagtgagtgagcactttgtgaaagatggcgtgcatggaagggttgcatatctttagtaagggaagctttgaagccaaagtgcaagtgggtgggtctccatgtggaacagagtaaggtgctgtgtggctggactcttgagcgctgaggaggctgtgggcatccaaccaggccagggcacctgttcttcaccatctcattaacacagccagcatatctgcatctgagattggcccactattctcctaatagagtgtctttcctgtttctcttttccatatcctgtccaacctggtgggcttcatagttcaggatgtgttcagtgaagccatgtctacactcactctaatccccactgatctctctctcctcatgaaaacccacaaattatcacctcattacttgtggatttgtgtcttttcactatttcatctgcctccctgtctagatcataagctacttgggagtaagaactgttttgttttttgtattctttccactcctccatggcattcactrcaacataaatcatagaggtcagaacatactgaagtgcattttgagttaaaatgctcaaaagtgatcttagtgacacgtgtttactttccctgtttatttaagctccagctataatgtttacctgcctaaaagttccatgttgccagtattaaacatacttctttttgccatgactaggcattgaaaggattgtaatgctttgttctrtagcccccaggtttccctagatgacaaataaacattccttttcctgcgtgaagatmgtctgtggaaaccttggycatggcatcgatatcagagcctgttacattcagagagttctgcccgttgtactatctcctcaatgccattccgacaaagatccagaagggtttccgctctatcgtggtctatctcacggccctcgacaccaacggggactacatcgcggtgggcagcagcatcggcatgctctatctgtactgccggcacctcaaccagatgaggaagtacaactttgaggtgagccttgctttgcttttcacctgagggggcacgagccatagctgacgcttaacatgcttgtgttctaggatgagataatttacttctgatttgccagaatatggccttaatacctcacccaaacaatactttaaaaccatctttagctgaagtggaatataactaaaaacattggtgtttttaactttttcctgcctccaaaaatctaacatcactttatttatttatttgagacagcgtctcgctctgttgtccagcctagagtgcagtgggacaatcatagctcattgtagcctcaaactcctggggtcaagtgatccttttgcttcaacttcctgagtagctaggaccacagggatgactgccacacccagctagtttttgttttgttttgtctgtagagacatggtttcactatgttgcccaggctggtcttgaactcctcggctcaagcagtcctcctgccttggcctcctaaagtactcggattacaggcatgagccaccacacctggcctaacatcactttaaaagagaatatcacctgaggtcaggagttcgagaccagccttgaccaatatggtgaaaccctgtctctactaaaaatacaaaaattagctgggcgtggtggcatgcacctgtactcccagctactcaggaggctgagacaggagaattgcttgaacctgggagatggaggttgcagtgagccaagatcacaccactgcactccagcctgggtgacagagtgagactccatcttaaaaraaagaaagaaagaaaaraagagaacattttagtatttaaaacttactacaacactttgaaagcagatatttttttcctaagtgtttacaggagcaggcacatgcctgtttttcaaagttttgaataatctctagttcttctcttgaaattatgatgaaaaaaggatgtatatgaatattggctcattgccagaatatgcacctcttagctgagctgaggtctcttctatagcattgggatcctgaccaatctgtttctgcagtgctgtggactcaggcatttctgtgtattgtagatattggtggagatgttatttgactgtgttgtggctggcaccaactattggtgaactgtaatgtaattcacccacttagtcaatatctgtagtttattgagtacgtcacttttgtgagagactcaaagttgactgagttgtggcttccaccacatgggactctattctgtctgtggttagggggcttttatggaccaagatacagcttttgtatctaagagaaatgtttacaaatacttgtgttttaatcartattcaatatattaaagttttcatttaaaacgtaactaatttaagcctctgtgctcattttaaaataatcaaaatggttcatacacatacagccctttctatgtgtcagacattattctttaaaaatatattttttaaattttttaaaacattattttttccttctcactatgcttcttggacagacatatattaactcattttatcctcacaaaaactctctgaggcagatgttattatgatcttcctcatttactaaggagacagctggtgaagagagggtaggtgacttgcctgaggttggctggtagtaaatggcagcaccatcatgtgaacttgggcagactgtctctagggtctgtattaatatatatatatatttttgagacggagtttcactcttgtcgcccaggctggagtgcaatgacatgatctcggctcactgcaacctccacctcccaggttcaagcaattttcctgcctcagcctccagagcagctaggattacaggcacccgctatcacacccagctaatttttgtatttttagtagagacggtatttcaccatgttggccaggctggtcttgaactcctgacgtcaggtgatccatctgcctcagcctcccaaagtactgtgattacaggcgtgagccaccacacctgcccgtgtattaatattttttgtataaaaattagaactactgctatttcttctctttgagtaatagctcatggattcgactgatcaaattccccaaacatttaaaaccattacgtaatctttcaaactgtagttaggagtttaatagtctgaaatctctcaaatgcttcagacactttataaggaagactcgtgaatccaacgatgaaccccaacaagatctatcaaagaaatccatgcacagaggcaccctagtcacactgctaaagatcacaatcttaaaatccgtgcacagaggcgtcctagtcacactgctaaacatcacaatcttaaaatccatgcacagaggcgtcctagtcacactgctgaacatcacaatcttaaaatccatgcacagaggcgtcctagtcacactgctaaagatcgctgtcttaaaatccatgcacagaggcgtcctagtcacactgctaaagatcacagtcttaaaatccatgcacagaggcatcctagtcacactgctgaagatcaccatcttaaaatccatgcacagaggcgtcctggtcacactgctaaagatcaccatcttaaaatccatgcacagaggcgtcctagtcacactgctgaagatcacagtcttaaaatccatgcacagaggcgtcctagtcacactgctgaagatcaccatcttaaaatccatgcacagaggcaccctagtcacactgctgaagatcaccatcttaaaatccatgcacagaggcgtcctagtcacactgctgaagatcaccatcttaaaatccgtgcacagaggcgtcctagtcacactgctgaagatcacagtcttaaaatccatgcacagaggcaccctagtcacactgctgaagatcaccatcttaaaatccatgcacagaggcgtcctggtcacactgctgaagatcacagtcttaaaatccatgcacagaggcaccctagtcacactgctgaagatcaccatcttaaaatccatgcacagaggcgtcctagtcacactgctaaagatcacaatcttaaaaatagccagagaacaatgacgtattacctgtagaggaacaatgatttaaatgactgtggatttctcatcagaaactgtattagcccgttctcatgctgctatgaagaaatacccaagcctgtataatttataaaggaaagaggttttattgactcacagttacgcatggctgcggaggcctcaggaaacttacagtcatggtggaaggcacctcttcacagggctcactgtcacaagaacaggagkggggaaaccatgcccatgattcagttatctctacctggtccctcctacgacatgtggggattatgggaactacaattcaagatgaaatttgggtgaggacacagccaaaccatatcagaaacaatggaagctggaagacagtagcatttttttggttttttgtttttgttttgttttgagacggagtctcgctctgtcgcccaggctagagtgcagtggcgcgatctcggctcactgcaacctccgcctcccgggttcaagcgattctcatgcctcagcctcccaagtagctgggactacaggtgcccgccaccacaccggctaatttttttgtatttttagtagagacggggtttcaccatgttcaccaggatggtctcgatctcctgacctcgtgatctgcccgcctcggcctcccaaagtgctgggattacaggcgtgaaccactgcaccaagcttgtttttttttttttttggcagagtttcgctcttgttgcccaggctggagcgtagtgactgcaacctccacctcctgggttcaaacgattctcctgcctcagcctcccttgtagctaggattacaggcacacgccaccaagctcagctaatttttctatttttagtagagacggggtttcaccatgttgtccaggctggtgtcaaactcctgatgtcaggtgatccactcgcttcggcctcccaaaatgctgggattacagctgtgagccactgcgcctggccgatagtagcacatttttaaagtggctgagaggccgggcatggtggctcacacctgtaattccagaactttgggaggctgaggcaggtggatcacttgaggtcgggaattcgagaccaatctggccaacatggcgagagccccatctctactaaaaatacaaaaattagccgggaatagtggctcatgcctgtaatcccagctactgagaaagctgaggcatgagaatcgcttgaatctgggaggcagaggctgcagtaagctaagatcgtgccagtgcactccagcctaggcgacagagtgagactccatctgaaaaataaaatgaagttctgagagaattgtcaacccgaaattctttactcagtgaaaatacctatcaagaaaggtgaaatgaaagtattaccagatgaaggaaaacttaagagggttcgttgccaaccgacctgctctaaagtcattgctaaatgaagttctttagacagaagggaactttgtacatcaagaatgaagaatggtaaatacctgggtaataaatacaatagatgatttttcccctattgagttctttaaaatatatttgacagttgaaaacaaaaattataactgatcaagttttaacagatgtagatgtagtaatatctaagacgagtacaacataagtaagggagagtaaggtatcctatacatttgtacattcttcttgaagaggtacaatattgattctaagtagattttgaaaaattacgtataggccgggcacggtggctcacgcctgtaatcccagcactttgggaggccgaggcgggtggatcacgaggtcaggagatcgagaccatccaggctaacatggtgaaaccctgtctctactaaaaatacaaaaaatgagccaggtgtggtggcgggctcctgtaatcccagctactcaggagactgaagcaggagaattgcttgaacccaggaggcagaggttgcagtgagccaagatcgcgccattgcactccagcctgggcaatgagagtgaaactccgtcccaaaaaaaaaaaagaaagaaagttggagtggctgtattaatatcaaggttttcttctgtgcaaagaaataaccaggggtaaaaaagacattacataataacagattcgtatatgtcccttaacaacatagcttcacacaatacacgaagcagaaatggacaaatctgcaattacatgtggagacttcagtattcctctctcaataatagaagtagtagacagaaaaccaacaggatgtagaagaactgaacaacaccatcagccaacttggtctaattcacatttatagaacactcagctgaatatacattctttgcaagtgcacatggaacattcatcaatatagaccatgtcctgagttagaaaacatacctcaacacatttagagtagactaagctttccaggcccttgtgttttactttgttttttcacttttctttaaaatataatttacacaaagtttgcaaatctttttttttttcgagacggagttttgctcttgttgcccaggctggagtgcaatggtgcgatctcggctcactgcaacctccgtcccccgggttcaagtgattcttgcctcagcctcccaagtagctgggattacaggcgcctgccaccacgcccagctaattttttgtatttttagtagagatggggtttcaccacgttggccaggctggtctcgaacgccagacttcaggtgatccatccacctcggcctcccaaagtgctgggatgacaggcgtgagccactgtgcccagcctgcaaatcttaatagtaccatgtgatgaatttatatgtgtatgcctgtttaatcacccagttcaagatacagaacatttccagcaccccagaagattctcttgtgctacctcctaatcattacccctccccaaggtaactattctgacttctaacacagagtagttttgacttctacagagtagttttgctagctccttgggttttaattcactattaagtaacctctggcagtaaggtttatatgcgttagcggaatttggactccttactcaggttgcagttacaacccagttttcttttataaagcacatgtgtctcattgatcaccattgtattgtcttttttgttttttttgtttttttttttgaggcagagtctcactctgtctcccaggctggagtgcagtggagcgatctcagcccactgcaatctccgcctcctgggttcaagtgattctcctgcttcagcctcctgagtagctggaattacaggtgcccgccaccatgcctggctactttttgtatttttagtagagacagggttttaccatgttggccaggctggattcaaactcctgatcgcaagtgatccacttgcctcggcctcctaaagtgctgggattacaagcatgagccactgcgcccggtcccgtattgtcttttagaaaaactgtataactatttaaatattttcagtcaccaaactaaaaaacaaatactaaagttgaagtttattgctccccagaatgaaactacaaattacatctgatggccatttttacagtttaaccaataattagttctctatcatattatctttgtttcgttttcctttaacagaatacctaagactagtagttgttctttttttttttttttgagatggagtttcgctcttgttgcctagcctggagtgcagtggcgcaacctcggctcactgcaaactctgcctcccgattcaagcgattcttctgcctcaatctcctgagtagctgggattacaggcatgtgccaccccatctggctaattttgtatttttagtagagacagggtttctccgtgttggccaggctggtctcgaactcccgaccccaggtgatccacctgcctcggcctcccaaagtgctgggattacgggtgtgagccactgcatccggccggaagttgyttttatttttttactatttttaatttttttaaagaggtttatttggcccacaattctgtagctggaaagtccaagattgggcagctgcatctggtggggacctcatgctgcttccactcatggtgggaattggaaggggaccaggtgtgtatcaagagatcacatggtaggccgggcatggtggctcaggcctgtaatcccagcacttcaggaggccaagacaggcggatcacgaggtcaggagtttgagatcagcctggacaacatggtgaaaccccatctctactaaaaatagaaaaattagccaggcatggtggcccatgcctgtaatcccagctactcaggaggctaaggcaggagaatcacttgaacccgggaggcggagattgcagtgagccaagactgcaccactgcactccagcctgggtgatggagcaagacaccacctcaaaaaaaaatatatatatatatatgtgtgtgtgtgtgtatatatatatacacatatatatgtatatgtatgtgtgtgtatatatatatatctatatctcacatggtcacatggcaagagaggaagcaagacaggaaccaaggatgccagactcattttcttttcctttcctttttttttttttttttttttttttttgagacagagtttcactcttgttgccctggctggagtgcagtggtgcaatctcggctcactgcgacctctgcctcctaggttccagcaattctcctgcctcagccttccgagtggccaggactacaggtgtgcgccaccacatctggctaatttttgtatgtttagtagagacagggtttcaccatgttggccaggctggtctcaaactcctgacctcaggtgatccacatgcctcaccctcccaaagtgctggaattacaggcatgagccacggcacccggctctttttcttttagtatggagtgcttcacaaatttgtgtgccatcctcgtgcaaggaagccagactctttttaacaacctgctgtcttggaaactaatccagtccttggagagtgagcactcattcacccatgaggagggcattaatctattcatgagggatctacccccatggcccaaacacctcctactaggccccacctcccagcactgccactttggggatcagacttcaacataaattttggcaaagacaaaccacatctaaaccatagcagatatgataagtcacgtgagctttgaaggactgtgacatggtagaacagcatccacaggctctaccagagtttggtggaacagcatccacaggctctaccagagtttgagggagcagcatccacaggctgtaccagagattgagggaagctggtacaaattactggatccagcaccatagaaggggactctgggagaatcccatgtaaagattttagctagtccaggcatagtggcacacacctgtaatcccagcactttgggaggccgaggcggacagatagcttgagctcaggagttcgagactagccttggcaatacagcaagacccccatctctacgaaagaatacaaaaattattcaggcgtgatggcgtgtacctgtagtcccagctactcaggaggctcaggtgggaggatcatttgagcccaggaggtcgaggtcgtagtgagccgagatcgagccactgcaccctaacctgggcatcaaagtgagaccctgcctcaaaaaaaaaaaaaatttagctagttatcctttaaatgtatttcacccatacatgcatatgcctgctgtgtacctacaaaaactttttaaatctaaaatattaacatttggaaaaaaaatgtattttgctggggccaaaatccatacttggtagccctgagtatcaacagcattttttgagcgcccattatatataggatatcaaacttataattgtggagaatcacaagggaggtataaaataaatttcttgtccaggcacggtggctcacgcctataatcccagcactttggtaggccgaggcaggcagatcattttgagctcaggagtttgagagcagcctgagcaacatggcaaaaccccatctctactaaaaatataaaaattacccgggtgtggtggcgggcacctgtaatcccagctactcaggagactgaggctggagaattgcttgaacccaggaggtggaggttgcagtgagtagagattgcgccactgcactacagcctgggcgacagagcaagactctgtctcaaaaataaaataaagtgaaaattttttttttggcaagaatgtagaatttagaggtagaagatttagagcttggaaacaaagctgtatacctatatgtaaacacataggaaaaggtctgaaggaattttcacatgattacttaactctaggtagggattaagattgggatgggctgagggaggaagagtgaaagggaattaygtatttttttaactttactgaggaattactagaaatttttggtacatattacacgcataaacacagcaacacaaagatttgttttgagctttggctgccagttattagtggtttaaccccagagatgaattaaatatttatgytgttgttgttgtcattttcatcatgagagctggctgggtcttagaatcatttggtacaatccccactttttatagataaagaaattctaagattcctgcttcaaggcacrtatctctgattgcctaaccattgtgcttacttcttgtgagaggaggtaggccctctgtgcagtctgtggatttcaaggatatggaatacagatgcgtggtctctttggaatgtccaagtcgaaagttaaagatgcattaactagtttagggaaaatctaagattttatgggaagataaataaaaaagtttatgctcaaataaatccatgtatggcatgattgaaagattatgtttttaaatgaagttatgtttcctaaagaggaaagcagaccttttctgtggtaaatatagccttgcatgtgttttcaagaatggtgctttggaaaccatttttttctacagaagttagtgggagagggcagatggaaacacagattcttcctacctagtgccaaaagcactgagaaaatgttgcaaggagctaataacaagtacaaaaatgttagaaatgtgttaaatatataggtctgatatgtgtaagcatagaccaaaaagactacctgacctgagtttctaatgttctgttttgaagttaaacatatgatcccttttccttagcattcaacaagccaatgagatttcatggatttgccttcagagctgtctttttttttttttttgagacggagtcttgctctgtcccccaggctggagtgcagcggcgccatctcggctcactgcaagctctgcctcccggtttcacatcattctcctgcctcagactcccgagtagctgggaccacaggtgcctgccaccacgcctggctaattttttgtatttttaatagagacagggtttcactgtgttagccaggatggtcttgatctcctgacctcgtgatccactcgcctcagcctcccaaagtgctgggattacaggcgtgagccaccacacctggctgggtggttgcagttttaaatagcattccagggaaggtctgactgagaaggtgacagttgaacaaagacgtaaagagcatgaccaacacaccatactgacatgtctgtattccaagaaaacggaagggaaaggcactgagcctgaaacatgtcttggatatttcgcattgagaaaagtcatgcttcagaatgttacaagtatttcattggcttatactttatagacatattttaaagaggtgcagaaaggacagtttttgtctcaccatagcagccaaggtgcatttgcccagtgccttccattgtctttccctgtgggagtaacttttaggtccagtgatgaggagcctgtgatgtctgtgttctggtttgttgataacattaccatacagggcttcacgggtgtccttcttagcatggattgcttccattcattggttgctggaaaatttgctttcaaatgtttttaacagtgactcttagggaaaaaaaatacattttattagatgtccattctccctaaatttacctgagttcaactgaattccaataggtttttttttagtgttaatttaaaaaaacaagctggccaggtgtgatggctcatgcctgtaatcccagcactttgggaggccaaggtgggcggatcacttaaggtcaggagtttgagaccagcctggccagtatggtgaaaccccatctctactaaaaatacaaaaattggctgggcgcagtggctcacgcctgttaacccaacactttgggaggccgaggcaggaggatcacgaggtcaggagatcgagaccatcctggctaacatggtgaaaccctgtctctactaaaaatacaaaaaaaaggccgggtgcggtgcctcacacctgtaatcccagcactttgggaggctgaggcgggcggatcacgagatcaggagatggaggccattgggctaacatggtgaaatgctgtctctactaaaaatataaaaaattagccgggtgagatggcaggcacctgtagtcccagctactcgggaggctgaggcaggagaatggcgtgaatccaggaggcggagcttgcagtgagccgagattgcgccactgcactccagcctgggcgacagagcaagactccgtctcaaaaaaaaaaaaaaaaaaaattagctggatgtggtggcacgtgcctgtagtcccagctactcaggaggctgaggcaggagaattgcttgaacctgggaggtggaggttgcagtgagccgagattgtgccactgcactccagcctgggcaacaagagtgaaactccatctcaaaaaaataaaaataaataaataaataaataataaaaatacaaaaattagccaggtgtggtggcacacacctgtaatcccagctacttgggaggctgaggcaggagaatcatttgaacctgggaggcagaggttgcagtgagccgagattatggcactacactccagcctgggtgacagagcaagtctctgtcttaataaatacataaataaaaatgataagctgatttaaaaatgcatatgaaattgtagtgggtggaatagtcatactagtggaaaagaggaagcaaatgggagaagttgctattaggtaacaaaacttatagagctttagtaattaagggagtgtggtattagcacaagaaaagatacatagatcactggaacagattagagaagtcagaagaccarcatgtatatggatacttgagtaattgcaaaggtgatacgacaaagtctttttcagtaaatgatgtgggacagctggatatgaatgggaagaaaaatgaaactggatccctacctcacttcatatggtggttattttgagcactttaaagtattaatgccactgtctcttgactgctgagattctgctggcagtgtaattatttcctttaccgggaatttgccttgtctgtttctgctttagatcttctctaatgatagagtccctggctttaggcttcttccttcaactccagtggatattccctactttgttttgtcctatggagttaagaaaattattccagaaaagcagatatctttgtttaacttccagatcattaaaaagttgtgttagtattcaaacattaaacagatgttctttgttagtaaaaggaggaaaatagtgtaaccattcttaataattgaatgaattcatatttggtcttaaatatttcaaaatatttcagatcaattctttggtatgctagtggtttctactgaaggttaagctttgacctactaaaagcagctcataaagaaagctttgtcagacttcagttcccatgaacctgctcacaaagaacactttttcccaatgtagttttgtcttgtgtatgaaaggaaaactgcctgccaaggaggctaagaaggttagctgaatgctattgtaatggtgagatgtttgtccagaaaaccattcctgacacctttcaaatcaaaagccttttttttttccttaaactttttgattgctggatttctgtttgaggaagttatgttgctacaatgagggtagcaataaatgcctcctgggaagttggaaataaaggcaaaggagagttaaacacaatagatgagatcagaaatgggcaaagttatcttaaagagacagaatggctccctggctagaataagactgaattgtccctagatcaaaaaaagaagagaatgtgtgtggcagaaggaagaaagtggactctacactgtgttagttaggaaaaccagaaattgggccaaattgcctgtttagtgggagagatagcttttgagagctgtgatcccgctggtgtggctggctctgggcagatatttgtatctgaaatgactcatgctgtgggacccttcctgagatctaacacttacagtggtttgatcagaaattgcaccatgcttgccaagcaacttttggactaaaagttgctgcccacgtatatcaggggaagaatatatatatatatatatatagtacctatcttagcatctgatttgtatgaccattacttcaatgtaaaataataaattggctttccagcttaaacttcaatttcttgtatattatatgatcatgagacaacctccctgggctgatcaacagcaggacgctaaaaagattgagtatctgagtcaggaaggtagagggccagaccctacatgtagctaattcaccattgtgaatctgcatgttaggtaaaactatggatttgttttttgtcttttgagacagattctcaccctgttgcccaggctggagtgcagtggcatgatctcagctcactgcaacctttgcctctgggttcaagagattctcttgcctcagcctcccaaatagctgggattacaggtgtgcaccaccacgcccaaccaattttttgtatttttaatagagacgggagtttcaccatgttggcgaggctggtctcgaactcctgacctcaagtgatccgcccacctcggcctcccaaagtgctgggattacaggcatgagccactgtgccaggcctaaaactatggtttttaaagatatacacgcatgtggtaaagctatgaatcaaagcaagagaatatttcatctcaatgttaggagagtggttttggtgggrtggggtatgtagtcaggcagaggcacacaagagcttcaaaggtgctgttaatggtccctttcccaagctagatggggattccatgggtgctcattttttagtaactctaatttaagctgtacatgttatatatagtcatggatatataatcattattttaaaaatgaaggcaaggaggataccataaaatgaggtacttcatatttaaccagctggcatcctaagcacctttcctgccctcccctctctgcacctggcagagttgatcacatcctccccattacccactatacatgggtgtcagtgccaatagtgctttgctcttgtattattgatgagtcttgctccttttcctaaattgtgaggcctcctgaaggcagcacccttgtcttatgaaaaagttgagcttctgaggatatgtctttggtgaattttggaaaacgtttagcctttatctctgaagataccacttttcattaccctctcttttcatttcctgctgaaacccctttttttgtttgttttttgytttgttttgttttgttttagacagagtttcactcttgttgcccaggctggagtgcaatggtgtgatcttggctcaccgcaacctctgcctcccacattcaagtgattctcctgcctcagcctcccaagtagcagggattacaggtgctcgccaccacacccagctgattttttttgtatttttagtagagacggggtttcactgtgttggccaggctggtcatgaactcctggacctcaggtgattcacctgcctcagcctcccaaagtgctgggattacaggcgtgagccactgcgcctggctgagaacccacttatgtgtagcttggacctttatgttctctcttctatgtctctaaacttctctttcatgttttgaatcttttcatctctttgttgcatggtaggtaatttcctcagatctgtcatctagttcaatacttttttttccagctgtgactaatttgctgttcattccacccagtgacattttaaattctcttggattttttcatttctatttccaatagtagttgttctttgcttacatttcagtttcctgttttatttttaaaacattttaatcatttttcttttatgttctgtgttcttcaatctaagtgaaatacttggggttgttcagtgctgttatggcttgttttacttgactcattcatgggcctgcttccctatcgtaatttctaattacgagcaatgtggctgatcctaatgtatgagaaccctgggggacctggatcgggactgctccacagatggggtttatgtttaccaatgccaggcaccttggagtgctaccaacatagaagcacttcagattaaccgtctgcatagagctttgcttggaaagagaataaattcaaactctgatgctgaatggggcaggcttatgatgacacattcttcggaaagattcttttttattcgttccaatcaatgcttgagataagacagatttccttgccagctccatttgccagcaaatcaatttttccctagcttactccttcacttagggttaggtccttgggattctggcttggcagagaatatcagctccagctccccatcatctactccgctctgaaaaccaaggctccagaggtgtgccagatagttacagggtagcctgtagcttcagggctagcttctgttttagtttgggggcattcttcttggttttggggtcctgtggattttccatactttcttgaaaattcagctgtgcatttgaaaggctttgttatatattgcactcagcattgccaggtgtttggagaggggtgttttgggatagctaggctattgtattgtgcaaaattaaagcctcatattctatttctatatgaactgtagttaagtgttaataatctgatgtctgggatgttttgattcttacatcaataactatgacatttattaataatcatattaaataacattaactcaagctcattggttacattacaaaggacactgatacattacaaagcacacatacaagcactgcacaccagtattgaggcttccagccccctctacatgatcatttatttatttatttatttttgagacggagtctcactctgttgcccagactggagtgcagtggcatgatcttggctcactgcaacctccgcctcccaggctcaagcgattctcctgcctcagcctcccaagtagctgagattacaggtgcgcaccactaccacctggctaatttttgtacttttagtagagatggggtttctccatgtgggccaggctggtatcgaactcctgacttcaaatgatccacccgcctcggcctcccaaagtgctgggattataggcatgagccaccgcgcctggtcatgatcatttttattttggaaccattcattcagaaaaatttcacagccattttgaacttgtgctatgacatggcaaaatctctagtaaatcattttaattcctgatgagttcatttttataatgataaatttctaaggaaaatattttgttttcaacttcttgccaccatgtcaagactgtacattttaaaacatattacatcacattttcccttcaaagcaatgccagtgaattctgttaatggtatcattcatctcatgttacccaactccagatcataaagtttccctcattctccttcctttccacaaacctaccaaatcctctatcgccaagtcctttgggttaattcacggagaaagtatcgagcacagaggcagaacagggcctctggagagtgtcacatttgtgtgtgaatcctgactcttgattttcactagctttgtaaccttagacaaattactaccaggcacggtggctcacacctgtaatcccagcactttgggaggctgaggcaggatcactggagtccaggagtttgagaccagcctaggcaacatagcaagatcctgtctctacaaaaaataaaaaattagctgggtgtggtggcacacacttgtattcccagctacttgtaggggctgaggtgggaggatcacttgagcctgagaggtcaaggctgcagtgagccatgatcgggccactgcactcagcctgggtgacagagcgagaccctgtctcaaaacaaaccaaaaaacaaattagttaacctgtctggagctcagtcccatatttgtaaaatgtggctaactacagcaccttcccttatagaaagctgtttgaggatccagttatgcatttaaagggcttaacacattacctggcacaggaaaacaaagacaagctgctgtcctgttttctttgttgctgccatccttctcacaaggtctcgacggagtctgtcttcatcacgatttcactgccctcatgcctgttctgtttaccccttttctagactgggcccttacttaccttagcctgagctattgtgaaacactcccagcggcttcctgacttgccccactccctccttccgccgtcctgtcctgctcctaatcgtgtttgtcagaaatgcctctgactgatacactggcaaaatcagaaatcttcaagggatccccctttttcttgctgtagcttaagatctaaatctcttaacctagatcacgatctgacactagatatatttatagtccatgaaaataccctgaaagctttcaagtaccagatgaaagtgagctccttcattaccacctcaactcactgtaggcggcttttcatgtgcaacagctaagctttaagagggctgggactgtgacctactttattttgtattgttatagcagctcacttggtacccagagcaaggaggtatatttgtttcttgcatatttggcaggttgattactatataaattactctattgaagattaaaatggtttactgaagatgtcgccatatatcttagcaaggtcaaaacagttgtgtaatttttctgaatgaatactttcaaaataaaaaagaccactcagaccagaagcctgaacatctgtgagcaatgcttatacatgtgctttttaataaaccaacatgttgggccgggcacggtggctcacgcctgtaatcccaacactttggaaggttgaggcaggtggatcacaaggtcaggagtttgagaccagcctgaccaacatggtgaaaccccgtctctactaaaaatacaaaaattagctgggcatggtggcgtctgcctgtaatcccatcgactcaggaggctgaggcaggagaattgcttgaacccgggaggcagaggttgcagtgagccgagatcacaccgtggcactccggcctgggcgacagagcgagactctgtctccaaaaaactaaactaaactaaactaaaataaaccaacatattaaactttaataggattattgatctgaaaaccaaaacatggtaggaattagtttataagtcatatttagacgcatcatcttataaccctctcagcaaaacctgtggggcaggtagattatggataacaagtgttcacttcatgaattgtccctgttgatcaggtgaagtagaacttggatctggggcagctcttgtgactccagattcttggtttttgagcaggtgttgggggaaatacctttcttgttgaagttctttagtactcttttttttttttttttgagatggagtcttgctctgttgcccaggctggagtgcagtggcgcgatctcagctcattgcaacctctgcctcatgggttcaagctgctctcctgcctcagcctcccgaacagctgggattacaggcacacaccaccacgccaggctagtttttgtatttttagtagagacggagtttcgccgtgttggccaggctggtcttgaactcctgacctcaggtgatctgcccaccttggcctcccaaaatgctgggattacaggcataagccactgcacccggcccatcttttaataagagctcrgcatattcatacttgattgatcagcattttcgtcattagaaatgaggtggggtttttttgtttttgtttttttgtgttttcatttcaaagattaaaaacctagagaggaaggagagtatttggggaaaatggtggaagagggagcaccagtcatctgtctccacacctagacatcaattgtactggcaggatctgtctgatctaactattttggaactcggaagtctactgaggyttacacattcttgctgggatggcaaactgtggttaattttggtcagtttcaactcttagcacagtagcagctatgcactccccaaccccagttctgtggaaggcggctacgcgggtgttcctagagcttgcacacagcgtgggagccagaataggcaaaaagcatcttgtcctctaaatatttggggtctgtgctctgactgctgattgctgcttctgatcgtagaggtgcagacaaagagatgggtggccattgtcgttacacctcctcattattgcaagttcttccccctccaattaacaagacttccaggggatttaaagagctaatggtcctgctcccttgcttcacttttattttttcccatttgggagccagatgttagagaatatgacattgaaaagcaactgcatataagggggagaattaagaagtgactgtgcatgcctaggaaaaggtataggcacagtaaagacctgagaagaccctgagtttatacccaagactgatctttggcacagacggcctacagtaaacaaaaagaatcacacacacatccacacacagaataacaaaacccagtaaacttgaaaaggggaggatctgattttctgaattaccacagtattagattcaaatgttcagttttcaacaaaacaaatcacgaggcacacaaagaaacaggaaagtatgctcttccaaggaaaaaaaaaacaactgaaactgtgagaccacatagtagacctactagaaaaagattttaaaacaactgtcttaaagatatgcaaacaactaaagaagatgtggcgctgggggcggtagctcatgcctgtaaacccagcacttggggaggccaaggcaggtggatcacttgaggtcaggagtttgagaccagcctggccaacatggggataccctgtctctactaaaaatacaaaaactagctgggtgtggtggtgtgcactggtaatctcagctacttgggaggctgaggcaagagaatcgcttgaacctgggaggcagaggttgcagtgagccgagattgtgccattgcactccagcctgggtaacagagtgagactccttctcwaaataaataaataaataagatgtggaaaaaggtaaaacagcgtatgaaggctgggtgtggtggcttacgcctgtaatcccagcattttgagaggcagatcagttgagtccaggagttcaagaccagcctggccaacatgttgaaacccgggtcatcgctagtaaataagacaaaaattagctgggcgtggtggcacaagcatgtagtctcagctactcaggaggctgaggcaggagaatcacttgtacccgggagatggaggttgcactgagccaagatcgtgccactgcactccagcctgggcaacagagacagattctgtctcaaaaaaaaaaaaaaaaaaagaaaaaagaaagaaaagaaaaaggaaaacagtgtacaaataaaatgtaaatataaataaagagatagaaaccctaaaaagaaactgaaaataattctggaactgaaaaatacaataactgaaatgagaaattcactggagggattcaaaggcagatttgagtaggcagatgaaagaatcagtgaatttgaagataagatattaaaattatcaagtctgacaaacagaaaaatgtttgaagaaacatgagcagagcctaagggtcatcatcaaagagactaacatgttttctgggagttatagaaagaaatgaaagggggagagagattatttgaagaaatagtatctggaagcttcccagatttgacgagagacatggatataaacatctaggaagttaaacgacctccaagtaagatgaactcaaggacacccacaccaagacacattacaatcaaactcccaaaagcgaaaaccaaagaacctttgggctggattcagtggctcacacctgtaatcccagcactttgggaggacaaggcaggaggatcacttgagttcaagctcagcctgggcaatatagtaagacctcatctctactaaaaatcaaaaaaattagccgggcgaggtggcatttgcctgtagtctcaggtcctcgggaggctaaggtgggaaaattgcttgagcctggaaggtcgaggctgcagtgagctatgattgaggcactgcactccagcctggcctaccgaatgagaccctgtctcaaaaaaggattcaacctgaggaagctgactaaaaaaacaaacttcagagaggagagaaatgcctcctcatatacaagggacccccaataagattataagcagatttctcatcaaaaactttggaggggycaggtgcagtggctcacatccataatcccagcactttgggaggctgaggcaggtggatctcttgaggccaggagtttgagaccagcctggccaacatggcgaaactctgtctctaaaaatacaaaaattagccagggatggtggcgtatgtgcctgtaatcccagccatctgggtgcctgaggcacaagaatcgcttgaatctgggaggcagaggttgcagtgagctgagatcaggacactgcactccagcctggatgacagagtgagaatctgtctcaaaaaacaaaacaaaacaaaaaaacaaagtttggaggcaagaatacagtgggctgatatattcagagtgttaaaaagaaagaagacctgtcaactaaccatctaatacccagcaaaactgtccttcagaaatgaaaaagaaattaagatattcccaggtgaacaaaaatggagggagttcattagccacaagacctgccccgcaagaaatactcaagtgagtcctgcagagggaaattaaaggatattaaacagttactcaaagccatataaagaaatgaagatcttggccgggcacggtggctcatgcctgtaatcccatcactttgggaggccgaggtgggtggatcatgaggtcaagagatggagaccatcttggccaacatggtgaaaccccatctctactaaaaatacaagaattacctaagtgtggtggcttgtgcctgtagtccccagctactcaaggaggctgaggcaggagaatcgcttgaacccaggaggtggaggttgtagcgaactgagatctggccactgcgctccagcctggtgacagagcaagactccgtctcaaaaaaagaaatgaagaaaaaaaaaaaagaaaaagaaatgaagatctcaaaagtgaaggatatgtgcaattttaaaagctaatattactgtaacaatggtttataattgcatttttgtgttctacatgatttaagagactaaaatgcttttttaaaattagtctaaaagctagtagtattgtaatgttggtttgtraatccacattttcttttcttttcttttttttttttttttagatggtgtcttgctctgtcacccaggctggagtacagtggtgtgatatgggctcactgcaacatctgcctcccgggttcaagtgattcttgtgcctcagcctcccaagtagctgggattacaggtgtgtgccaccacacccagctaatttttgtatttttagtagagacggggtttctccatgttggccgggctggtgttaaactccgacctcagttgatctgcccgccttggcctcccaaagtgctgggattataggcgtgagccaccgtgcccagcccacattttgttttctacataatttaaaataatttttttggtaaaataatttctaaagcatttaaaataattatttactttatggtttggggcacacagtttataaaggtataattttgtgatatcagtaagcaaaaaggttgaggacccagctgtaatggagtggagcttttctgtgttactgaaattaagctgatagaaatttaaattagtgttataactttaggatgttaaatgtaatcctcatggtaatgacagagaaaatcactgtagaatatacacaaaaggacatgagaaaggaatttaaatattttaatgtacccccaaaaatcaactaaacacaggagtagacagtaatgcaggaaactagggacaaaaaccttaaggcatatacaaaacaaaatgacaagccaggcgcggtggctcacgcctataaccccagcactttgggaggccgaggcgggtggatcacgaggtcaggagttcaagactagcctggccaagatggtgtaaccccgtctctactaaaaaaacagaaaaattagccaggcatggtggcggggacctgtaatcccagccacccgggaggctgaagcagagaattggttgaacccaggagacagaggttgcagtgagccaaggtcacaccattgcactccagcctgggcaacagagtgagactcgtcgcaaaaaaaaaggaacaaaatgatagaaataagtccctgtttattggttaattaccttaaatgtaaatggattaaactctccaatcaaaagacaaagattgtcaaaatggtttttaaaaccaatctgggctggacgcagtggctcacacctgtaatcccagcactttgggaggccaaggtgggtggatcacctgaggtcaggagttcgagaccagcctgggtaacatggtgaaacccaaactctactaaaaatacaaacattagctgggtgtagtggtgcatgcctgtaatcccagctacccaggaggctgaggcaggagaaatgcttgaacctgggtgacagaggttgtagtgagctgagattgcaccattgcactccagcctgggcaacaagagcaaaactccatctcaaaaaaaaaaaaaaaaacaaaaaacaatcctactatatgctatatataagagactcacggccaggtgcagtggctcaagcctgtaatcccagcagtttgggaggccgaggccagcagatgacaaggtcaggagatcgagaccatcctggttaatatgatggaaccctgtctctactgaaaagtggaaccctgtctctattaaaaaatacaaaaaaattagccatgcttggtggtgggtgcctgtagtcccagctactcaggaggctgaggcaggagaatggcgtgaacccgggaggcagagcttgcagtgagccgagatcgcaccactgtactccagcctgtgcaaaagagcgagactccgtctcaaaaaaaaaaaaaaaaaaaaaaagagagactcactttaaatccaaatgttgctggtgaaaggatagaaaaagatattccatgcaaatagtaatgaaaagggatcggggtggctattctactatcagacaaaaagagttacagaattgcaggaagaaatagacagttctacaataaaagttggaagctttaatatcccactatcaataatggatagaaaaataaagaaactttacatgataaaccaactagatttaacagacatttatagaacactctacccaataacaatagcatacattttctcaaatgtagatgggatgttttccaggatagacyatatgttaagccacaaattagtgtcaatagattttaaaagatatacaaagtatgttcttattgcaaccacaacaggataaagttagaaatcagtaacagaaggaaaattggagaatccacaaatttgtgcaattaaccatatactcttagtcaaccaaagggtaaataaagaaattacaagagaaatttaaaaatacttaaagatgattgacaatgaaaacacacataccaaaatttatgggacagtgaaaacagtgctaaaggagaaatttatagctttaaatatatacattaaaaaataagaaaaatctcaaatcaacaacctaaactttaccatttaaggaactagaaaaggaagaaaaactaaactcaaaactagcagaaggaaggaaataataagattagaacagaggtaaaggaaatagagactagaaaacaatagagaaaatcagtgaaaccaaaagttgaatttttgtaaaggtaaacagaattgacaaacctttagccagatggatcaagaagaaatgagagaagacacaaatgattaaaaccagaaacaaagtagacccttactattgattcaacagaaacaaaaaggattatgacaggatggtgatctgttgaataccaacagattggataacctagatgaaatggacaaacccctagaaacacaaaacctactgagactaaaccgtgaaaaaatagaatacccgagtagatctataattagtaagaggatagaatcaataatcaaatatctccttgtaaagaaaagccctagacacgaagccttcaccagtgaatttaaccaagcatttaaagaagaactaacactatttcttctcaaatttttccaaacagttgaagaggagggaatacttctgaattcactctatgaggccagaattatgctgatatcaaaactagaaaagataaccacaagaaaaatacacatcagtatccctcatgaacattgatgcaaaaatcttcaagaaaatactagcaagtaaattcagcagcatattaaaaggattatacaccatgaccaaagtgggatatatttctggaatgcaaggatggttcaacatatgaaagtcagttacctaatatgctgttttaacaaaatgagggacaaaatcacatggtcactccactggtccataaaaagcacttgacaaaattcaacacccttttatggtaaaaacactcaacaaactgggaatagaaactaccccaacataataaaagccatatatgaaaaacagtgaacaattatacttaatggtaaaaaacggaaagcttttcctctaagatcagaaacaaggcaaaatgcctgcttttgtcacttcagttcaacacagtgctggaaattttagccagagtcattagccaagaaaaagaaattaagaggcatcaaaattgggaaggaagaagtaaaagtatctctgtttgcagatgacatgatcttgtatgtagaaaccctaaagattccacaaaaaattgtttgaactaatacatgaaactgacatagtagcarcatacaaagtcaatgcacaaaaatcagttgcatttctaaacaccaacaatgaataatatgaaaaagaaattaagaggaaaattccacttaaaatggcattaaaaagaataaggaggtgaaagactcatacaatgaaacatgaaacattgctgaaagaaattaaagacataggtaaatagaaacacattgtatgttgagaaattggaagacttaacattgtgtgtttggtttttggagacagggtcttgctctgtcacctaggctggagtgcagtggcacaatcacagctcactgcagcctcaatctcctaggctcaagtgatcctcccacctcagactcccaagtagctaggactacaggcatgcacaactatgcccggctttttttttttttttaattttttgtagagatggggtctcactatgttgctcaggctggtcttgaactcctgggctcaagtgatcctcctgccttggcctcccaaaattgtgggattacaggcatgaatcaccccgactagcctgacttaatattgttaagctgtccataccacccaaagtaatttataagttaattcaatacaatttctatcaaactcccaaggccattttttggcttgggagttttagaatataaaaatttattctaaaattcatatgggatctcaggagaacctgaaaagccccaacaaacctgaaaaagaacaaagctggagatctcaaacttcctgaacttaaaacttaactgcaaaaatgcagtcattgaaacagtgtattggacttggctgtggtatgaagaaataagaaaaagaagagaacagcatgatacataaaaatagacatagagaccgatgaaatcaatagcccagaaataaaccctcttatatagtcaagtgaaatttttttttttttttgagacagactgtcactctgttgcccaggctgcagtgcaatggcgtgatctcggctcactgcaacctccacctcctaggttcaaatgatgctcctgcctcagcctcccgagtagctgggactacaggcgtgtggcaccacacctggctaatttgtgtatttttagtagagacaggatttcgtgttagccaggctggtctggaactcttgacctcaagtgattcgcctgcatcagcctcccaaagtgctgggattacaggtgtgagccaccgtacctggcccagtcaagtgatttttgataaggacgtgaagattgttccacagggaaaggacagtcttttcaacaaatggtataggggaaactggatattcacatgcaaaagaatgaagttggacccttacctaatactacattcaaaaattaactcaaaatggccggggcctggtggctcacacctgtaatcccagcacttgggaggcccaggcaggcggatcacttgaggccaggagtttgagactagcggggccaacatggggaaactctgtctctactaaaaatataaaaaattagccaggtgtggtgatgcatgcctgtagtcccagctactctggaggctgaggcatgagaatcacttgaacccgggaggtggaggttgcagtgagccaaggttgcaccattgcactccagcctgggcaacagagcgaggctccatctcaaaaagaaacaaacagacaaaaaactcaacaatgaaaaaacccaattcaaaaatgggcaaaggacttgaatagatgtttccccagagaaggtaaacaaatgaccaataagcatatgaaaaatgaccatcactaattattagggcatgcatgtcaaaactataccccacacccattaggatggctactgtcaaaaaaaagaaaaaaaggaaataacaagggttggtaaggatgtgagaaatgggaaccctggtgcattgttcacaggaatgagatgatgcagccaatactagaaaacagtatggtggttgctcaaaaaaattaaaaatagaattaccatatgataccaaaattcagtcctgagtacagtatgtacccaagataattgaaagcagtatctcaaagagatgtttgtacactcatattcataggagccttattcacagtagttaaaatggggaagcaatccatgtgcgtctatcaacggatgaatggataaacaaaatgtagtatgtacatacaagagaatatgagtaagccttaaaaaggaaggagttctgatatgtgctataacacggatgaaccttgaagatactgtgttaaggagataagccagtcagaaaaaaggcaaatactgtatggttccatttgtatgaggtatttagagtattcaaaatcacggtaaaaggaatctgaggagattaaaaaaaaaagagtagtcaaaatcataaagacggaaagtagaatggtagttgccaggggctggggggagggatgaatggggaattattgtttaatagagtttcagttttacaagattaaataktcgtggagatggataatggtgatgattgaagagcattatgaatgtattgaataccactgaaatgtatactttaaaaagggatactggtaattttacgttatgtgtattttaacattaaaaaattgggggatgagggctgggcatggtggcccacacctgtaatcccagcactttgggaggccaaggcgggcagatcacgaggtcaggagatcgagaccatcctgcctaacacggtgaaaccccgtctctactaaaaatacaaaaaaagcggggcgtggtggcgggcgcctgtggtcccagctactcagtaggctgaggcaggagaatcgcttgaacccaggaggtggaggttgcagtgagccaaggtggcgccactgcactccagcctggtgatagagtgagattccatctcaaaaaaaaattaaaattggggcatgagggcagggtgcagtggctcacatctgtaatcccagcactttgagaggcccaggcaggaagatcccttgtgcccaggagattgagaccagcctgggcaatatagtgagaccttgtctctacaaaaaaaaattaaaattacctgggtgtggggcacacgtctgtagtcccagctacttgggaggctgaggtgcgaggatcgcttgagcctgggaggttgaggctgcagtgaactgtgattgcaccactgccctcctacctaggtatatttgttttttggtttttttgttgttgttgtttcttgttttttgagacagagtcttgctctgtcgcccaggctggatgcaatggcacgatctcggctcactgcaacctccgcctcctgggttcaagtgattcttcctgcctcagcctcccaaatagctgggattacaggcatctgccaccacgcccagctaatttttgtgtttttagtagagacggggtttcgccatgttggccaggctggtctcgaactcctgacctcaggtgatctgcttgccttggcctcccaaagtgctgggattacaggcgtgatccaccacgcccagccctgtttttgtttttgttttttcaacagatgtaatttctgacttgtataccttttcaatcaagaatatgtatggactgcagcctgatgaagtttttcactcctttagtaatgtcctccttgttttacattttcaaagcctgcatagttacagattcatttgttttcaacgtttccccaggggaagacggaatctatcactgtggtgaagctgctgagctgctttgatgacctggtggcagcaggcacagcctctggcagggttgcagtttttcaacttgtatcttcattgccagggagaaataaacaggtgagtactcatgatcttaacacgtgttaacttcttggcacattcctcatggatttttaaaattagaaatcctcatctgcttrgaaagtttatgctcagagaaagccgggcacgactttctctgcccaggctcatgcctgtaatcccagtactttggaaggccaaggcgggctgatcacgaggtcaagagatcaagaccatcctggccaacatggtgaaaccccatctctactaaaaatacaaaatttggccgggtgcagtggctcatgcctgtaatcccagcactttgggaggccgaggcaggcagatcacgaggtcaggagatcaagaccatcctgactaacacagtgaaactccatctctactaaaaaatacaaaaaattagccgggtgtggtggcgggtgcctgtagtcccagctactagggaggctgaggcaggagaatggcgtgaacccggaagacggagcttgcagtgagcggagatcacgccactgcactccagcctgggcgacagagggagactccatctaaaaaaagaaaaaaaatacaaaaattagctgggcgtggtggtgcgtgcctgtagtcccagctactcgggaggctgaggcaggagaatcacttgaacccgggaggcagaggtcacagtgagctgagattgtaccacgctactgcactccagcctgacggagcgagactctgtctcaaaaaaaaaaaaaatgctcagagaagcttaacactgtgctgtttataattggagaacatttttgtgctgggttggacacttggcataaagtacatgtgggtcatttcatttttgcttaatattctcaaggtatgctctctgtgggttttgaaggtgactagacagatggaactttgtgcagggttctgcttggaaaacgagattgggaaaaccagctcttccctaactaggagygattgtataccttttccatgtagccccagctcacagcatttatcctttttttttcttgtgtatatttttatcccttgttcatagcttcggagatttgatgtcactggtattcacaaaaatagcattacagctctggcttggagccccaatggaatgaaattgttctctggagatgacaaaggcaaaattgtttattcttctctggatctagaccaggtaaaattattttcagaaatactgttggctcttaccttcttacatttggaaaaactatatttataacttgtatttttagtcaacttgtattcttgatcatcatccctttataatctcaattgttatttgtaacatttacttttatagacttatgttttataagcttccacttctatgactaaggagttggcctactggaacattcacttttttcattccactgttgtgtattacttttacttgraaaagaagctattatcattcctacttccttgaaaggttagtaggagtgatgccaagcacttctgaatcctaactgtggacaagtcagtgatttcaatggatggaggactctgccagccacctggcctgtgtgagatgacctcatgtgacaggaagtggcagaggaggttaggtggcagtatggtgaagatgaagaaactggagtgccaagagatccaggaactagtccaggggtgcaggcttgcacctcacagagcttgctttcaaactgtgcttctgcttcgacgcccgtgccttttccactgcacgtatggcttgatgatctgctgggttttatttgttttgtcatgtgtctgcaaccaaactgaactccttggtggcacagtcctttctttttcttatttgtagccttcattcctagagcactataggaattcagcaattttttttttttttgagacagtctcgctcttgtcgcccaggctggagtgcagtggcccaatctcggcttgtgacaacctccatatcccgggttcaagcgattctgccacctcagcctcgcaagtagctgggattacagggacctgccatcatgcccgactaatttttgtatttttgtagagacggagttttaccatgttggtcaggctggtcttgaactcctgaccttagatgatctgcctgcctcggccttccaaagtgctgggattacaggcgtgagccaccacgccyagccaagaattcagcaattattagctgcatgactttcagtccctctgatccaagactgacctagtacaaatattctctagtagtagttctcaagctttgtagtcacaggatccctttacactcttagaaagaggaccccaaagcatttttgttcatatgggttatctctaccaagtacaccatgttagaagttacaactgagaaatttaaaaatatacatatttttttgagatggagtctcgctctgttgcccaggctggagtgcagtggcgcgatctcggctcactgcaacctccgcctcccgggttcaagggattctcatgcctcagcctcccgagtagctgggactacaggcacctgccaccacgtctgactacttttttgtattttttgtagagatagtgtttcaccgttttagccaggatggtttcaatctcctgaccctgtgattgaaatctcccacctcagcctcccaaagtgctgggattacaggcgtgagccactgcgcctggctgaaatttaaaaatattttactttgaaataataaatccataacatctgcacataagtgacatattttgtgaaaatatctctatagctctattttcaaaacaggtgagaagagtgagtggcattgatttatatttttacaaatttctttattatctggcttaatagaagatggctggattctccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaaataaaaaataaaaaataaaaaaataaaaacacacctcaccaagctcagccaccaacttaaaaaggactggacaatacttttaccactttcccttctcagaattcaggcctgtcctcggaatgctacagggtacagcccatttgagctcctgtatggatactcctttttgttaggccccagtctcattccggacactagaccaacttagactgtgccccccctcaaaaaaaaaaaacttgtcatccctactatcttctgtctagtcatattcctattcaccattctcaactaactcatacatgccctgctctggtttacactgccggtttacactgtttttccaagccatcgcagctgatatctcctggtgctatccccaaactgccactcttaactcttgaagtaaataaataatctttgctggcaggactgtgctgaatctccttaggcactctctaatcagatatcctgagtcgtcccaattcttagaccttttatacctgtttttctccttctgttattccatttagtttctcaattcatccaaaaccatatccaggccatcatcaatcattctatatgacaaatgtttcttctaacatccccacgatatcaccccttaccacaagacctcccttcagcttaatctctcccactctatgttcccacgccgcccctaatcctgcttgaagcagccctgagaaacatcgcccattctctctccataccaccccccaaaaatttttgccgccccaacatttcaacaccattttgttttatttttcttattaatataagaaggcaggaatgtcaggcctctgagcccaagccaagccatcacatcccctgtgacttccacgtacgtatacgcccagatggcctgaagtaactgaagaatcacaaaagaagtgaatatgccctgccccgccttaactgatgacattccaccacaaaagaagtgtaaatggcctgtccttgctttaagtgatgacattaccttgtgaaagtccttttcctggctcatcctggctcaaaaagcacccccactgagcaccttgcgacccctgcccctgtccaccagagaacaaccccctttgactgtaattttccattaccttcccaaatcctataaaacggccccacccctatctccctctgctgactctcttttcggactcagcccgcctgcacccaggtgaaataaacagccatgttgctcaaaaaaaaaaaaaaaaaaaaaaaaaaaaaaaaaaaaaagaagatggctggattctgcattcaatctgttgccatacattgttttgattgaagtgtataaagaaaaactggctttacacagacatgtagttggaaatgggaggagtattttgatagccttttcagatagttgtggacattctttaataatatcctcatatgactacctcataaagcaaatggtagttgctttaaaggttacggtgacaaatgacaaatggtagtttctttaaaggttagtaaaaatgtggaatctgaaaccacatggatgaatttttcctactctgttacattaaaatctactttacccatgttggattttgtaacattatgtattggtcacttagaaaatactattcacagagtgatgcagatcttccaaatgttgacacttttttttttttttttttttttttgagacatggtcttactcctctcacccaggctggtgcacagtggtgcaatcacggctcactgcagctttgacttcccaggttcaggtgattcycccaccttggcctcccgagtagctgggactatgggtgcacaccaccatgcccagctgatttttttgtatttttatagagacagggcttcgccatgttgcacaggctggtcttgaacatctgggctcaagcaatctgctcaccacagtcttccaaagttcttggattacaggtttgagccaccgtgccagctgataaattttctaatacaatatcaaaaaaataccttcattaacatcaacatcattgtaatcgggaaagtctagctataaggaatcatgtcaagttcacagggacagatacaagttttcagattgctaatctttgtgtgagagcaacaaataccattacttgttttccttgaagtgacaggcttttttttttttttgagaaaatgtctgctaaatacccaaatttgaataattacagcatttcaaataaaaatggtgttttgtgaaaaaagcagctggctcagctcatagctgcaacagttgcacaagtggtttccttgagagaaccactragtgtatttcagtgtgcagcagaagggagaatacaaaagtacctatcctctggccaggtgtggtggctcacacccgtaatcccagcactttgggaggccaaggcaggatgatcacttgagcccaggaatttgagaccagtctgggcaacatggcaaaaccccatttctaccaaaaaacataaaaattagccaggtatggtgatgcacacctgtaatcccagctactctggaggctgaggttggaggatcagttgagccttggaggtggagattgcagtgagctgagattgcaccactacactccagcctaggccaagagccagaacctgtctcaaaaaaaaggtttgcaacattttcatgtaatggaaatttctttatcttgattttggtgttggttacatgactataaatttgtcaaaattcatagaattgtatacccaaaaagggacgaaatttactgtaagttttaccaacaaatctgatcactgccccctacttccctcacaaaatgtcagtgatgttacagcagtatttctgaaataattgatgaaacttttcatatatatattggatttcatatatatgaaatatacatatatttcatatatatataatgtatatatatwtwtwttttttgagacagagtctcactgtgttgcccaggctggagtgcagtggtgcgatcttggctcactgcaacccttgcctctgggttcaagtgattctcctgccgcagcctcccaagtagctgggattacaggcatgtgccacctcgcccagctaaattttgtatttttagtagagacgaggtttcaccatgttggccaggctggtctcgatctcctgacctcaaacgatccacccacctcggcctaccaaaatatagggattacaagtgtgagccactgcacccggcctgatgacacttttctgtaaaagtaacttacagaatcagattttttatacaatgaaatatgctttgtgttagcagtcgtatgccttctagaattttattttgtgtttatatataaaatatggtttttttttcttttttaaagacagagtctcactctgctacctgggctagagtgcagtggtgtgatcacaactcactgtaacctgaactcctgggctcaaatgatccttctgtctcagcctcccaagtagcggggaccataggcacgtgccaacatgcctggctaataaaaaaaawttttttgtagagacatgatctcacaatgttgcccaggctggtcttgtaaagtatcattttatgttaatagcattttatatatttaatatcatttaatttcttctaaccttctgttttctattaccctttcagttggcaaggatataatgtcctcaaagctgctttgaaccctttgtgaggggagactataatatgaacttacagagctgattattgtcgcaataattttatagaatgttccattccattgttttataatagaataagcaatacacacagtgcaacagatttctgtttagatctttatggattcttctttgaactctctgcatgtttactgcatcatccctgagcctgctatggtgcacagtaaagaatgtatctactgaggacatgtttttaaaaattatgcagattttaaaatgtttcctgtcaaactggatgcagcatgagggagatgttagtatggactcttttcccatccgtcaaataatctcgctatggtgggttgagagtgaatctgcagagagtgaaagcatgcgttaagtaaggtgcaagctgacctaagcacagctagcgggaaggacactgacttgtcctaagggaggtccattctttagcctggcgctgatgtgaggtgtaaccagactttctctgccaggggctctgtaactcccagctggtgttggaggagccatcttccattgtgcagctggattatagccagaaagtgctgctggtctctactctgcaaagaagtctgctcttttacactgaagaaaagtctgtaaggcaaattggaacacaaccaaggaaaaggtaagtttcacaagtttgccagtttggcctaaatgctgggccttgttgtagaaggtgctttagggtttcttaggtctcctgtttgccggagacctcctgtttgcaaacccacagcgcctctaagcctggggttcctggtggggccctgtgcctgcttaggatttctcctcccagaggcagacaagaagagtgkgttcttcttgtcgcagagctgtaggagcctgcacacacagccactctgcctctcagggtgccacagtcagcgcagagaagcctcaggggtggcctggtctatctgttccttgtggagccacctcctccacacagccctggtgaggggtcagggttgtggggstcactcgttattcagcacgtgtttaccatgcacccctgtgcactgtggcaggctcagcagtgacatggtaaacacggcagatctgagccctccgttgtggaaatggaaacacagatagaacacttgttgaccactgtgtcagctgctgtggaccaaaatacacaggatgctgtgtgagtttagacacacttttgtccaggtgaagggtcagggaagacatcctgaaggcatgggttccaggttgagagatcattcctcctttgaccagtgatgtggaggaagggcatcgagaagtccaccagccataccagccgtgtgggaaaagacaactggaacacctggggaacctgtaattcatcatcccaccctagcctgtaaagcactcttgtaggactctgcagcgagtttgcgtggggatggggtgaggaggggtaggtagagcagtggagctgacccctcctatgccaaggaggaggtagactggggccaacgtgggggtgggaagcagagggcggcattagtacagatcatgcgttgatgagtctacagtcatggattgtcgattggccgatgggagctggaagagttcccgtcttgtgtctcccaggaaagggcactgtttgcctgcatagaatcaggggcagggcagctgatggtcacggcatgtggggagggcttgaggctggccctgtggagagtgacagcagggactgggaaacatggtgagattggcaggcgttgatgaggccctgcggctggtggtgccgttggggacaggccgtcctggagagtcgggtgaggcggagccagcccctgtggtcgtagtcacygcccgttattctgtgttctgggctttgcggcaacacacaagtttattctcttttctgcatggcagccctccggctgttaaaagacgctctcaaacctcccctttcttctattttcgatgctgaacaccttcttttttctttttctttttcttttttgtttgagacagagttttgctcttcttgcccaggctggagtgcagtggtgcgatcttggctcactgcaacatctgcctcctgggttcaagcgattctcctgcctcagcctcctgagtagctgagattacaggcatgtgccaccacacccggctaattttgtatttttagtagagacagggtttcaccatgttggtcaggctggtctcaaactcccgacctcaggtgatccgcctgccttggcctcccaaagtgctgggattacaggtgtgagccaccacatgcggcctgctgaacaccttcttaatcccatcaacaatctggcctttttatatctgcagtctccctttcggtccctggagaactcagtggaatttatggccctgcagatcttagttctgctgctctctctgccagtatcctactcctctggcattttatcctggttcgtctgtcaatgttttactgcactgtcttggaaggaaggcagagtgtaaagagaggcattgaaaaccaattactttacatgtgggtcctattcccaacaatctctcttaaaacctggcccttggccggacacagtggctcacgcctgtaatcccaacactttgggaggccaaggtgggcgggtcacttgaggtcaggagttcaagaacagcctggccaacatggtgaaacctcctctctactaaaaacacaaaagtttgccaggcagggtagcaggcgcctgtaatcccagctactcaggaggctgaggcaggagaatcgcttgaaccggggagacaaaggttgcagtgagctgagactgcaccaccgcactccagcctgggtgacagagcgagacttcatctcaaaaaaatcgaaaacaaaaaaacaaaaaacaaacctggccctttaacctcttgtgtggagacccaggcagtttctgtaaacctctcctagtgcgtctgtgcagtcaagtctttagggaacattgattgaaagcgtgctctgctccccaggaacgttttaggatgcagaaacaaataaatgtgtccccttctcagaaggagagagattttaytgagccttggggaaatgagggctaacagaataagaggaaatgtttttaacatctgtgtcttaaagacttgctttctgctgtagactattgtgtgcgtctatccctggaagcagtgcttccctcacaactgtttagtgagcggagctaggcatgtacacgtggaggcgtgacagcaagtacggaggcatccaaggagacaaggcctctgccctcaaacacaatgagagagactgtcggtcagcaggaggagagtagaggctgtcagtgctgtaaaggagcgggctaggtgaagcattagggagtgctaggcatggggcaggaagttgcatttggataggatggtcaggaaaggcctctacaagggcagtgatctttgagctgaagcctgggaagagctgctggaagagcattccaggctcagggaacagcatatgccaagacctcaattgggcaagagcttagatgttcaagaagccagaagtgactagggcactggctatggctggagtccaggggagccgtggggaggctgacacgggagtccaggggagccgtggggaggctgccatgggagtccaggggagctgcgaggaggctggcacgggagtccaggggagcctggcatgggagtccaggggagccgtggggaggctgccacgggagtccaggggagccgtggggaggctggcacgggagtccaggggagccacggggaggctgctgcaggagtccaggggagccgcagggaggcaggggagccgcagggaggctgccttgggagtccagggaaaccattgactgagatggagactggagactggggaaggctgggccagaggtcaggacatcaggacctctgctgtggacataaggggtttgacgggcctgtcaggtggctgcgtgggagtcgcagaagagagttctgtggaccggtctggagcccagggaagaagtcttgaccagaggggaaaatgaggtcaccagatacaggtgacactgacaccctgacattggatgaatccacgcagggaatgtctgttcattcagcgctggagctttgcgccaagcctctgccctgctccagtactcctcatcgggggatatctrtgaacaaggcagaacagatctctaatctcagggagctgtgtgcagagtagtgaacagataaacatgtcagagggtgcagagccagagagggaggagcaggagacacaggtgtctctttaataggatgacagggaaggctcctctgaggaggtagcatgggctgattcctgaaacaaagaggcaactagtgcgagaagaccttagagagaggctctggaggcagagggccctgcgcaccgaggatctgagcagccaggctggctgtgtggagcacggtgtggggagccccctcccgtcggctttgtgggccctgcccatggggctctttcagtccagtgctgtggtcagtcacagagggctgtggccaagccagggaggtcactctggctgctgcttggaatatgctggagggggcaggtgtggcagctcagcagggccagcaaggattctgggtgatccgggtaggagaagacaggatggggcggggttggtggtcggactgcttccaaggcagagctggcagatttgctgccacgttggttctgaggtgtgagagggatgagttggagatgattcctaggtctgtggtctatgcagctgggtgagtggacatgcygtggattgacgcagagaatcctggaggcacggggagaaggaggagatggaacagcctgctgtggccccgccatgtcctctccctgcagtggagagctggcgtgggaggcgggtggcgggtgtacctctcggggagctgtgcgctggcagccactggcatgcagacaggagctcgcctagggagatttgggcaggcttgtgttctgaagaggaaasggcatcaggagagaacaggagttggggggtcagaggagtcggaggccatatggagggacatagcagctgctgcgagaccgggggctgaggcagcttcgacgggcctgagtctgtagcatggaggctgtgcasagccctcctcatcagcagggccaagggattggaagggctgaaagaggagttgacggcgagtatggagagcttttaggaggagtgtttttgtagaagagaacaaagaaagacaaataggtggtgcccaggggggaaccatgtggcctggtgggagttttgggagaggggccgtgtggcagcacattggtgtgtgacgcgggtgcctgtggagggaacacagtgctggtggggacagagtgcaggcggtggcctcagttgggccctctcatgggcagcagtgtagggttgaccagaaaccgggacagagactctcttccagagaaagggcagggcactgagcacagggcaggtgcaggcaggtcaggaggcccagaggtagaagacgaggggtcctcttcccgtcgagtccgtgaacctcttcagaccggatgatgtgtgttacatccagaaaacctcagaggccctagccatctgcaaccgtgggtttgctgtcctgtgtatttatgttgcattgtttcatgtgtcagagccctctgcagacctgttactgtgtcccctgtgagtctagtactcagggaagccctccctggcagtagcactttgccctggggaaggagaaggagacgcagcaatctgtaggtgtggcgcccgcatgtgggtaagagccagcagccggttctggaaccccgcgactagcacatctgtttggatggccagtgggtgttagctgttgagatctctggcagggcttctgtggatccttcttctcactcagcttagactttcaggctcccattttgggtgctgtcagctttcagcgtatcagctctgtggcaccatacattatgcacaaaatcataaaacaccattttatagctagaatttgttagccagaacacactccttacatatcaacgtggtctataaagggaattaaaatttttttaggtaatcartgasgtttttggaaatcatctctaccgaaattaagaaattatattaatttgtttatgattttagaatcctgcaatacttagaccttaaaagttggagcttcagtgtcaaattcagaaagcaccagcaagtactgcagaatcgcactgcaagtggatggtggctgagtcgggggcttaggacaatttgtacctggctctagctggttcttcacaacttcactgcctttgaccaacccactcatcagacatttccgttctttttattttttagagacagggtcttgctgtgtcaccaaggctggggtgcagtggtgtgatcacagctcactgcagccttgaacagctgggttcaggcgatcctcctccctcagcctcccgagtaactaggactacaggcacgcaccaccatgcctggctaaattttttaatttgtagagatggtgtctctctaggtcacccaggctgttgtcaaactcctgggctcaagcagtcctccctccttggcctccaaaagtgctgggattacaggtgtgagccaccatgcccagctattcagcagttttagaggcagccmctcccaggaccttgctcagcagggctcctttcccttcctccagggtaagagtccacctggtgttcaggacctcgccttctcatgcccactcagatgcaccaccttgatctgagctctttgagcagctctttgagcctcagatggcgcttccagatgctgatgtgattgttcacacaggtcagcacagtgttatgagacaggctgaggacctcatcttatttattttttattttacccagagcatcaaacacgatgtcttacagaatgtaggaatcactaaatgtttgttaacatgagtgctttagttacataagatgaaccagtcaaaatggaaatgacaagagatttttcagaggtcctacaaatagaaggaaaacatttaaaaattggatcgccaagagaaattgattgacaggaaaggcagaggaagagattatgggctcccttgctggaattcctctggttcgctctatttagaggacatctccaraacaaacccaccaaaggcagtaatcagatacgatgctgttgatagagttgtccataaaagatccacgatgtcaaaacacccttggttcgtcctaacgatcattgtttcaaagctgaatttgatatataatatcctccttggaccctatccaaagggatttagttactgaggtgccagagggacctagtgagattctggtgtgcgaagaaaccccgcaaataactatctgtttgcctatgtgggtgggccctgggggtgscctctagggttgggtgtgctgctgtgtgcagggagtgtgggaacaggcacagcacaagttggccgaggtctggtggggaagcagtggcacggaggcagctctcaactgtgacctgcctgtagcctcgttcaggacaattgagcacttatggggacttagtgtcacaagcattgcttttgtgctgcatgtaagtaatctcattaattcctcacttcagcctttgagatgggagttactctgcctggtttacagaatgggaaacgggtccagaaaagttcaataattgcacgtaccacatacccactaggtgtcagggctggacatcgagcccagggctagctctaaaaccagtgctgtttctgcttttcacaatctgagaagtatttgggagaaggaatcagccaggcatagggctgaactgaaatgcttacatgtgaactctgttagcatcctgagaaataacgagaactcagattgccagtgggagtgtagattgtataatcacgtttaaaaagcttgaagttgtcttctaaacttgaatatgctctcagcaacccagcgattaccccacagcccaccaactgcatcctgagtgtccgtgacagactctgacacctgtgggctaaggggtatgcacagaaatgctcatagcacaattgctcaaaatagctttaaaaaataataattgaaatatccatcaacaagaaaatgaataaatgaattgtggaatacattaagtcctcgtttaatgtcattgataggttcttggaaactgcgacattagcaaaacaacgtataacaaaaccagtgtttttccctcaccaatgttgttgaaggagatggtgttatctgaggacctgctctatgtcatttcgcttacagttgtagtttctaagaacctgtggacgctgagtaggacgtactgtaccattcagcagtagaaatgaattagtgcgacagcttctttttatcaagaaggataaatctgagaaacatagtgttaagtgagaaaaagcaaaagagtacaattagcatcatacattttaataaaaatgaaagataaacaatactaaattatattgtctttagagatacatagatatgtgattaaaccaacaaaaaagtgaggaaatgataaaggcaaaatgcagtccagtggttccatctggggcacaagggggcaggaagtgttaggagcacaggagaacattggttggrtgactgatgatttctttcctaagtttggggatgggttcccaggtgtacctttccttgctaggcttcataactgcatggatatatgtacatatacacagtggtgcactgcataacaacatttcagtcattgacggactgcatgtatgacagtggtcgcagaagattataatggagctgaaaaaattcctatcagctggtgtcttagcgccacacattacgtgttctgtttttagatagacaaacagtcatcattatgttacaggtgcctacagtgttaagtacagtcatatggagtacaggtttgcagtccaggggcaataggctagactaagcttgtccaacccacggcccaacacaaatttgtaaactttcttaaaatgagattttttggccaggcgcagtggctcatgcctgtaatcccagcactttgggaagccaaggcaggtggatcacttgaggtcaggagttcgagaccagcctggccaacatggtaaaaccccatctctactaaaaatacacagttagctgggcatggcggtgcacacctataatcccagctacatgggaggctgaggcaggagaatcacttgaacccaagagggagaggttccattgcattgagcccagattgcgccattgcactgcatcctggacaacaagagcaaaactctgtctcaaaaaaaaaaaaagaggttttttttgtgactattattattattattattatttttagctcatcagctattgttagtgtattttatgtgtggcccaagacaattcttcttcttccaatgtggcccagggaagccaaaagattggacagccctgggctagactatgtgggtgtgtcataggctgtgccatctaggtttgtgtaagtacgctctatgatgttcacacaacgaagacatcgcctaatgacatatttctcaaacatccctgtcactaagtgacctgtgactctatatatagcatattcttttgtttgtgtcagatatttcataatttcagaaagaaaaaatatcaagcttgggggcaggaagggacattggtgcctctgatgggtttagagaaattctgaaaaggcaacaatatagatgggttgctgtgaagctcattcattcaggatgtggactgagcacagcaatcagacgtcagaagcaacagaatcagagcagggaaaggatgagcagacctggattcttcaccttctgcctcagtttcctctcctccaaaacgggagttgtaatacagtcatgtgtcacctaacaactggaatatattctgagaaatgcattgttaggtgacatctttgttgtatgaacagcattgagtgtactgacaagcgtaggtggtaggtacagcctacttccacctgggctaaatggtacagcatattgctcctgggctacagacttgcaccacatgtgactgtactgaatactttaggcagctgtagcacaacggtaagtaattgtatgtctaaacatagaaaaggtaccataaaaatatggtattataatcttatgggaccactgttgtatttgcggtccatcattgactaaaatggtttgttgttgttgtttttgaagcagagtcttgctctgtcacccaggttggagtacagtagtggcactatctcagctcactgcaaactctgcctcccaggttcaagcgattctcctgcctcagcctcccgagtagctgggactacaggcatgcgccaccatgcctggctaatttttgtatttttagtagaggcatggtttcaccatgttggccaggctagtctcaaactcttgacctcagatgatctgccgycttggcctcccaaagtgctgagattgcaggcatgatgcatccagcctgaatacaatgttatgtgatgcgtgactgtatctgccactcatggttgttgtaaggattagacacgagagtgggatcaagtgccaggcacagtgcaggctgtgtgagtactcagtgaatggttccctgtgtgctaatggggcacacacctgtgagggtgtggtcgggcctctgttggtacagggatgacagtgtggtttgacaaaaaacaaacagtagaaagggtgaaaaatcaattattgtcttagccaaaaaattcttgttgtacttaatattaagggttgacaactgcattactttaaatcagtccatgtctgttttttgttctttctttctttcttctaattttagtactgggaaatttggtgcttgttttataccaggactctgtaagcaaagtgatctaaccttgtatgcgtcacggcccgggctccggctatggaaggctgatgtccacgggactgttcaagccacgtttatcttaaaagatgcttttgccgggggagtcaagcctttwgaactgcacccgcgtctggaatcccccaacagtggaagttgcagcttacctgagaggcacctggggcttgtttcatgtttctttcaagaaggctgggtgctgagttggaatgaatatagtatctatctcctagacacagtcaaccaggtaagtgaagggackccrccatatcttctgtgtctataggcaagagaatgtatctctataaactgttctactcagggacctcagaatgctaccaggagcagtattgacttacactttactttttcctttgggccagtcaaggaaatcaaatgaaggtttggtaatttttatagatttgaaaaaaaaaatttggttttgacatttaggtccaattttctgccgagaaatgatgtatgttttttgtatgtaaacacaaaattaaacttgttctttttkttgttgttgttgttgttgttgttgttgagaaagagtctcgctctgtcacccaggctggagtgcagtggcatgatctcggcttactgcaacctccacctcccaggttcaagcgattctcctgcctcagcctcctgagtagctgggattacagacgcatgccaccacgcctggctaatttttgtatttttagtagagacagggtttcacaatgttggtcaggctggtcttgaactcctgacctcgtgatctgcccgccttggcctcccaaattgctgggattacaggcgtgagccaccatgcctggtttttttttttgttttttttttttgagatggagtcctagtatgtcacccaggctggagtgcagtgtgcagtggtgcaatctgggctcactgcaacctccacctcccgagttcaagcgattctcctgcctcagcctcccaagtagctgggattacaggtgcgcaccaccacgcctggctaatttttttgtatttttagtagagacagggtttcaccatgttggccaggctggtctcgaactcctgactcaggtgatccgccagcctcggcctcccaaagtgctggggttacaggcgtgaaccgccgcgcccggccgccacttggttttttttttgttttttgttttttattttcagttttctttacttagcaatatatcttgggcaaatttccaacatcattaaaatcatggtaggaaataatttctgcttaaaccaagatgataacagattatcatcagagacagatttagaaactttaaacaaagctgtttagtttcagtttcyccttgtcttaagagcagagcttttgctctttttaaaataaactccctgccttaccctcccgactcctcacccccagactctagaccaggccctgtcctgttcacgttcttccattctgagctcagcgggcctctgacaggcacccctttcttttataagcagagcctcactgtagaaaataaacagttttcagccaggcgcagtggcttatgcctgtaatcccagcactttgggcactttggaaggccgaggtaggtggataacctgaggtcaggagttcaaggccagcctggccaacatggtgaaactccgtctctactaaaaatacaaaaattagccaggcatggtggtgggcgcctgtagtcctggctactcgggaggctgaggcaggagaattgcttgaacctgggaggcggaggttgcaatgagccaagatcacaccactgcactccagcctgggtgacagagcaagacttcatttgaaaaaaagaaaagaaagggttttcttctttggtgtgtgtyagcagaacatgaagttcatcttctcctcattgaagtyttatgaattattatcagccgtacctggtaacactggtttggcagaaagaaaactggcccggggtggggggcagaactagactcgactcttctagcctggttctgcctttaaccaagagtctcttatcggccggagcctggtttgttttcctgtaaaatggggtgggggtrgaagaagcatcgacttaggggaatcaccaaggtgccttgagtttgttcattttataagggatattctgaaaggtatttttgcaccctttcctcagttacagagaacttctttccctggataccttttgaacttatgtgcacttattaattagtagcatcaagatgctttgtaactgtgcattggttctttcatctgagcatttacccgatgctttacccagtaggtataattaacttcattttataggtagagaaatggagacaggggaccgtctgggacagatgtcacagtcaccctcagagactggaccacccagtggcagcatgactggcagctttcggaaacaaatgttatgtttgcagcagtccatcagttatttaaaattagccaaaaacatagactctccttctacaacagactagtctctttatttgcactgtctacagcaaagcaaggacttgctttaagtcagtgtgggctcaggatgtcctgtgttttgttgccacccactttcagataatgctggaggaacctcccctcccttcatgtattcattcaaaacccatgagttgcagtgcgcactggcctctcctgcaggaatgcacacagtagggggactagacgtgtctgcacgttatttcagcccaggagtggggcgtcaagcggaagtttggatgaggtgctgcaagccctgagagccctgggtgttgcagcagagggcaagcttgtcagaggctgcttctcacagaggtggcgtctggagagaactggaacttccccagcaaacatggataggaaaggaatttgagcagaaagagaagcacgtgcattcaccatggaggaacagggctgggactgggctggcagggccggtgcacctgcagcagggacgagggcagggtggtacgtgggtcggagatgaccgaggccccaccatgccaggggacccctcagatcctgcttaccaatctgtgagatgttacctaactttggattgaattggaattttcagaaagttaccatagtaaagtgcagttatcatttgactgatttggactctcacacatgcatttttatgctttgagctgttaccgttgtttagttttgtgttttttgttttttttttttttttttttttgacaggccacaattgctggtttggaaggatccggtgatattgtgtctgtttcgtgcacagaaaatgaaatatttttcttgaaaggagataggaacattataagaatttcaagcaggcctgaaggattaacatcaacaggtttgtatttattataaaatgtaccatgtatatgatgggaagtactatactctgttgtttgtaattgcagttaataattgatcaaacttaccattgggccaggcatggtggctcacgcctgtaatcccagcactttgggaggctgaggtgggtggatcgcttaagctcaggactttaagaccagcctgggcaacatggtaaaaccctgtctctaccaaaaatacaaaaaactagccaggcgtggtggcatgcgcctgtggtctcaagtactcgggaggctgaggtgggaggatcgcttgagcctgggaggcagaggttgctgtaagctaagattgcaccactgcactccagcctggatgacagagtgagacctcatctcaaaaacaaaaccaaaaacttaccattattttgctaaactattgcaactttatttgaacttggaggatttggagggtttcctctgattctttttttttttttttgagatggagtttcgctcttgttgcccaggctagagtgcaatgaggcgatctcagctcaccgcaacctctgcctcccaggttcaagctattctcctgcctcagcctcctgagtagctgggattacaggcatgcgccattatgccaggctaattttgtatttttagtagagacagggtttctccatgttggtcaggcaggtctcaaactcccgacctcaggcgatccgcctgcctccgcctcccaaagtgctgggattaaaggcgtgagccactgtgcccggccgctcctctgattgttaaaatagcatttacagtacatttcttgaaagtcacctactttaaggcttacatcagatagtctcacatttagtggagttgctttcatggttgtggaagatggggagattgagaaaggaggaaggaaaaatcagaaaccactttactgatccctgctctccgtctgagacagtatgtgggattaatgctccaaaagacatagatttgcatagagttttagaatatttaaatctgtcatctgggacataccgtttacccttaactcagttcttccttgtaggatttatttttctctgtgcttttgacattttttggtaattcatacaagcccaaattttaatgagcaaagaatcctaatatgtgtcctcttgcggacatccacatgctttatatatttgggttcctcggggaacttgttcctcatggtggcaacaacagccatgtggaccccatcaccctcctcctcactaccattacctctgatgtcagagagggcaaattggggtgaatattccaaaacataatttgtataagaagtgaataagctctgactcttgagtttatgagctgggggcccctcagacagtgtcatcaaagggttagaatggctttcaggaagggtggtgacttggagccaccaggctaagctctggacctctgctgcccatagagctttctgcagtgatgaagatgctcccatctgccctgtctggtaggcagtccctgtccatgtgtggctgctgagtacttgcaatatagcaagtgcagctgagagatgaattttacattttgtttaatttttattttattttattttattttttgagacagagtcttgctctgtatcccaggctagagtgcagtrgtgcagtctctggtcactgcaacctccacctcctgggttcaaacgattctcctgccttagcctcccgaatagctgggattacaggtgtgcaccaccacaccaggctaatattttgtattttagtagaaagggggtttcaccatgcaccatgttacccaggctggtctcgaactcctgagctcaggcagtcctcccaccttagcctcccaaagtgatgggattacaggcatgagccaccgcgcccagcctaaattttgttcaattttgatcaatttgaatttcaatacttacaagtagctggtggctgcctrttggacagggagctctaggcaagatctgccattaagttatgtaatcttcagcaagtcgcttcacagcagagtcctcccctccagtctccagtgtacacttcattgcctgcagtctgcccctaacacatgccctcaatagaatgtgggtgcttcaagggcaggaattcctgtgtcttatggactgccatgtcccagcagctagccctgtgtctggcacacggaggatccccgataaagagaggatggcgaatggatcaaagtgggctgtggtcttgtgttgagggtactgtagctggaactgctctggccttgtgccctgtggtgtcgtgttgcagraaagatgagtccactgcagtgggaagctcactggcccttgggcttggggacaggagacaggtactcacatgcctgttctcactctgcggtctactggccttgatgctgtgtggtaatggacttctctgtcttgagtttgttctaatggaaaattacctttccctcttccaggaaacttaattacaggtacacatgtatttttcaaatgccctttgagtaatcttaaagtatattcaaggcagagtcttagtatgaagtataactaagctgttttgttatacacaggcatctctcatttgtaaataatttgtaaattgaagcgagaaatgctgtattcttagtatttttttactttttttttttttttttttgagacaggtttcactctgtcgtgcaggctggagtgcagtggcatgatctcagctcactgcaacctccacctcccaggctcaaatgattctcccacctcagcctcccaagtagctgggactatgggcgtgcaccaccacaccctgctaaattttgagactccgtctcaaaaawaaataaataaataaatataaaaagaaagctatggcaaattattttactgattttaatatatgagcttcttgaagaacaaaaactrtttcttagagtcttttgtatgattcttttagttttggtggattttttttttttttttttttgagacggagtctcactgtgttgcccaggctggagtgcagtggcgcaatctcggctcactgcaagctttgcctcccaggttcacaccattctcctgcctcagcctcccaagtagctgggacccccggcgcccgccaccatgcccggctaattttttgtatttttagtagagacggggtttcactgtgttagccaggmtggtctygatctcctgacctygtgatccrcccgccttggsctcccaaagtgctgggattacaggygtgagtcaccgtgcccatcctagttttgctggtttctatgaatttagaatcattcagttctttagctggctggtgcctctgtgacaactggtatttagggctagcaaacgtggataagtgcacatcagctctctcttggatcaccagtggtaaaaccagactcttctttcttagtgagagatggtctggagatgtctggatgctcagagcgtgtccacgtgcagcaagcggagaagctgccagggrccacagtttctgagacgaggctcagaggctcttccatggccagctccgtggccagcgagccaaggagcaggagcagctcgctcaactccaccgacagcggctccgggctcctgccccctgggctccaggccacccctgarctgggcaagggcagccagyccctgtcacagagattcaacgccatcagctcagaggactttgaccaggagcttgtcgtgaagcctatcaaagtgaaaaggaagaagaagaagaagaagacaggtaccctctgtagctggcacacacccatctggggttacagtctttccagattctctgggagtgctgctgctcactgagtgagcaatgctccatacatccaaaagcagagaacacatacatttcttccccaaaggagttttactgcaaaatacttcacattaacggaaaatmcacacacacacacacacacacactgtaaggtctaaatgatgacagaacacctgtgtgtactcaccaccctgcttaaagggtctcagttttgtacttttcaatatttatttatgtatttatattatttatttattttttgcgacagagtttcgctcgtcgcccaggctggagtgcaatggcacgatctcggctcactgcaacctcacctcctgagttcaagcrattctcctgcctcagcctcccgagtatgcatgcccagcgaattttgtatttttagtagatacagggtttctccatgttggtcaggctggtcttgaactcccaaactcaggtgatctgcccgcctcggcctcccaaagtgctgggattacagcgtgagccaccgcgcctggcatagtttttagtatttaaattaaaatgtcggggccgggcgcagtggctcatgcctgtaatcccaacactttgggaggccgaggcaggcggatcacgaggtcaagagattgagaccatcctggccaacatggtgaaaccccgtctctactaaaaacacataaattagctgggcttggtggcatgtgcctgtaatctcagtcactcgggaggctgaggcaggagaatcacttgaacctgggaggcagaggatgcagtgagccgaggtcacgccactgcactccagcctcgcaacagagcaagactccgtctcaaaaaaaaaaaaaaaaaaagtgttggtttatccatgtataccattgattaaatcagagattctgtgagcctgggtggaaagttgtggaaaccagaagatctatgctggtaaatacttgggacattttatgtttagtgttgaatatgctaccaaatatgggatttaacattgaatttttttctttttttttttcaacttttattttaaatacagggggtccatgcgcaggtttgttacatgggtatacagcacccaggtagtgagcacagtatgcagtaggtggcttttgacccatgccgcctcctctcccgctctggaggtccacagtgtctgtccttcccatgtttatgtccatgcgtgctcagtgtttggctcccacttacaagtcagaacatgctgttggttttctgttcctgttgcattaatttgcttaggattacggccagcggttccatccatgttgctgtaaaggacaagatttcattctttatttttatttatttatttatttatttatttattttttaatttattggagacagagtttcactgttgtcacccaggctagagtgcaatggtgcgatctcggctcactgcaacttccgcctcccaagttcaagcaattctcctgcctcagcctcccgagtagctgggattacaggtgcccactaccacgcccagctaagtttttgtatttttagtagaggcaggggtttaccatgttggacaggctggtcttgaactcctgacctaaggtggcccacccgcctcggcctcccaaagtgctaggatggcttatgagcgtgaaccaccgtgcacagcccagatttcattctttgttatggctgtgtaacactgaatttttcaaaccttttactccttggttcctgttaatcctctctagctaagatgactgcaacactgaaggaaatgttattagatttctaagcattttaataattataaggaattggtttgtgacccaggtgaacatctcagtttgtcccctggtttttcttagctgccctcaaacccatggatttgttcagtacttgcatgcatagaaagcatctctttgttgggattatttgtacttaagaggtttattcttcattcaccaaatatcctttatttaaaattttttttcttgagccaaaaatatgtgtgcaagttagtctcttactaatcatatagaaccgtgccttattttgaatgttcttattctgaattagaaggtggaagcaggagcacctgtcacagctccctggaatcgacaccctgctccgaatttcctggggacagtccccagtccttgaacacagacttgctgtcgatgacctcaagtgtcctgggcagtagcgtggatcagttaagtgcagagtctccagaccaggaaagcagcttcaatggtgaagtgaacggtgtcccrcaggaaaatactgaccccgaaacgtttaatgtcctggaggtgtcaggatcaatgcctgattctctggctgaggaagatgacattagaactgaaatgccacactgtcaccatgcacatgggcgggagctgctcaatggagcgagggaagatgtgggaggcagtgatgtcacgggactcggagatgagccgtgtcctgcagatgatggaccaaatagcacacagttacccttccaagaacaggacagctctcctggrgcgcatgatggggaagacatccaacccattggcccccaaagcactttttgtgaagtccccctcctgaactcactcactgtgccttccagcctcagctgggccccaagtgctgaacagtggctgcctgggaccagagctgatgaaggcagccccgtggagcccagccaagagcaggacrtcctaaccagcatggaggcctctggccacctcagcacaaatctctggcatgctgtcactgatgatgacacaggtcagaaagaaatacccatttctgaacgtgtcttggggagtgtgggaggacagctgactccggtctctgccttggcagccagcactcacaagccctggcttgagcagcctccacgggatcagacattgacgtccagcgatgaggaggacatctatgcccaygggcttccttcttcatcctcagagacgagtgtgacagagctcggacctagttgctcccagcaggacctgagccggctgggtgcagaggacgccgggctgctcaagccagatcaggtatgtgggttcgggtggtgggaaaagtagctgaggcttctttcttaagggtaataattgtcaagactgattattttccttctcatggaaagaaattctattcctactgcaaaatccgtaggccaactctgttttcaagtctgggtttcaggggatttccagcacagggactatgaatggcttgaactacttctgacctgttctaccctgctcagtaacctgcctccccaaccaaggtagcgtcttgctgtttcctctgaccccacaagtgcaggctggtgtaggcacttactgttagccatcgtagggcagggctgaattggcctggggccatctcagaaaaccagtgggcagaggactgtccacctgtggagtagagaaagctctgagcagtttggaggcagggagtctcctgtccttctcctcacacccctccaaggaaccatctgcaagagcacgaggccatttccagaactgctgtctcctcaacctccgaacagtggctccaaggctcccctgcgagctgtacaggaaccagtttggagtaaccagtctttgtaggtccacccagcacatgtaactaggagatgacttttaactgtccttgagcattttatattaaaagtgatttttttaaaagtgcctacttcccttagcaagtaattattactagatatatttgtttcaaaactgtgtcttgccctgtctcctactaactgtcgatgtgaggtatgaattatggctgcgcacttacagccacgtgtgctttccacagtctacrctggcttctgtcagtgctagcagtgtgacgctttgtcagtgctcaccatgtgcaggtatcccacaaagcactttagaggtttaactcttttacttctctaaacacgaactataaaataggcactcttcttgtccccattttacagaggagaaaatggaagcacagaacagctagacagcttgcacaaggtcacatagcaaatgaagggcgggccccaggaccccctcactcaccctctgtgctgtcatgcctcagaagtgaaacatgctgcttacttgttttgagacaaaacgccataagtctggcttttttttcttctttctttcttttttttttttttttctgagacagggtctcactctgtcacccaggatggagcrcagtggcgcaatcatggctcattgctgcctcgacctccccaagctcaagtgatccacctgcctcagcttcctgagtcactgggactacaggcatgtgccaccatgcccagctaatttttgtattttttgtagagaaggggttttgccatattgcccaagctggtctcgaactcctgagctcaagcaatctgcctgcctcggcttcccaaagtgctgggattacaggtgtgagctgctgtgcctggccaagggtggccttttattcagtcatccggcatttatcttttcaacccagtggttcttgagtggccttgactgtcagcctctgtgattatgctggggaccacagtgcagatggcagctagttgtggattccatcttcctgagcctcagagtcttgagggggagccaggtacatgttcacatcctcgcagttgagtgggactcaggtgagggtactgagcaaagtacagggctgcaggaagcgcaagcagcatggccccctaatgtctgggcgttagccaggcagactgtcggtggggtggggtattggaattctaggccagaaatttaggaaagccctcacttaggtgacagggatcctggccctttgagcccctgactctctaacttcctcccttcctcatcccactccaggtagctgggaagccaagaaattttatggtgtgtttttatttggaggttcggtgtggaagtaagacttgccatggtgagcagggctggattgagaagagttgggcaccattttctttgaagtagttaacttctatgtgggtatctgtacaaatacatttatcttctttgcatttattgaaaagtattaaagtacaaagactttatttagctttgatttttaaaagaattctagcaaggtcgggcacagtggctcacgcctgtaatcccagcactttgggaggccaaggtgggcgaatcacctgaggtcaggagttcgagaccagcctggccaacatggcgaaaccccgtctctactaaaaatacaaaaaatagccgggtgtggtggcagatgcctgtaatcccaagtactcaggagcctgaggcaggagaattgcgacttgcttgaacccaggaggcggaggttgcagtgagccgagattgtgcccctgtactccagcctgggcgacagagcgagtctctgtctcaaaaaggaaaaaaaaaagaaaatatggtggaaaaaagaaagacagtggtagtgccatatatccagtgcctctgtaatgattagactacaaaaaattgacttgcatccaaatgttgaagaacctggctctttgtgtaaggtgaggtatgcctgcagaataatagcagctccttcgtaacgtgatgtgatgctctaagcgttacatttgcaaaggtgttagaacaggagaaaatgtcatccagggactccagggagtctttgtagggagacagcagcacgcgtctcagaacgtttgtagtagaggggtgtccacagatagcaggggttgggagaagggttgacttggcgtcttgctgacccgttttaccgtctcgtgttaatgatatcctctcacctttcttactgagaacagtaagccaaatgtggctgtgtcctctgccacagaactcactggctcttcccttgttagtttgcagaaagctggatgggctactcgggtcccggctatggcatcctcagcttggtggtctccgagaagtatatctggtgcctggactacaaaggcggcctgttctgcagcgcgttgccgggcgccgggctgcgctggcagaagtttgaagatgctgtccagcaggtggcagtctcgccctcaggttcgcctccccgctccctgctcccgctccctgctcccgctcgccgctcctgctccccgcccccggggtgcagacatcttagtacagggctcccctgcagcagctctgggctcacgctgccgtgcgttcaccaggtttgcctcttcaggaacgtttgaggggttgtctccaaagaacgtgaattgcttcattggatgtcaattcgtagtgtaaatgggtgttcagtttgagtttttgttttctttattaattgcaatggtaagctctgatcgtatttttgtaagctagacaaaaagtttgaaaattgagggacttttttagggatattaatatactaactcttcataaaaataatacgtgtttctctttctcattgttgctttaaagcaaccgaactaacgaagacgggcctatggatatgttrgatatattccaattatttggcttcctctttaggaattctgttttaatgagctctctgctgtgggtgaacagtctactccctgactctaaaaggaaagtccattcattctttcatgctgctsttaggccattgttagtgaactgsagctggtgtttcctgaacgatgttctcctgagctggaagacctcccatatctgcatggaatcatttgcttgctttttctttctttctttcttttttttttttttttgagacagagtcttgctgtgttgcccaggctggagtgcagtggtacaatctcagctcactgcgagctccacctcccaggttcrcactattctcctgcctcagcctccccagtagctgggactacaggcacccgccaccacgcycagctaatttttttgtatttttttagtggacacggggtttcactgtggtagccaggatggtcttgatctcctgacctcatgatccgcccgcctcagcctcccaaaatgctgggattacaggtgmgagccactacgcccggctttgcttgttttttcttaaggttgtgttggccacgtcggcacctacgccagtggggacacttttgccttgaagcagcctggtttactgtcaggacattggaatagaagtcagacgaagccgaagctgagtctgtggcttgggacctgtctgttctctgtaacttcactgtgtttcgggatgaatttcccttaattctccctggtctctgtcactgtttaaaatattagtttgttcagcgttgtttttcttgcttgctttcactgtttgtttgaaaaatatttttctttagagactggctaacaacccactccacaagctgtcattacacagttgtgtgttttaattcatttctcgttggtatcatttaccttcaggtttgtctccttagccttttagaactttggttctattcctgactatattagttacttgtattcccaggccccttggtccctcactgtgctagcgggaactctgtatctccatgagattcacctgctcagttgaggcgtccttcagggcccagtcccatgtccttggtgggcagcagagcccttgtgccgggggcaccacaggcagagatgctcgacaggccctctagtccagcccagctgacactcggtgatcactggtggccccttgccttgcctgcgtcggcctgctccaggcctccagctgcagcgctatcctgccttccctttcctctctcctcctccatctcttcatcaaagtcctcttcacagtgaaaacaggccaactcagtgcaagtgtgttccttctgtgcaccttttccattcagctcatccagaactgatccttctctttgaatccctaaaggactttttcagcctctcctagggcactagttgtgcttaggatgtttatttggagacttatcaaacctaataatgtcatcagtgtttctcctcccgtgtgaggagcgcctgtcatgtgcccagctctgtggccatgtggttgatctgcttccgtctgcagtctttagagcagccctgtaaggtggagatgatccccacggcccaggaggaaagtgaagcttggagacgggcggtgacatggagcctgaagctgcatagccactgggtggtggccaagggcccaaacctgggtctggtggcctctttccccacttggggggacagaacaggatgtgttttagaaatctttctcccctcaatgcccagcatgaagacttttgtatagaaatatattctagtatttattggacagtgaatagaatttttatttccataggagcccttctctggaagattgaacagaaatctaaccgggcttttgcttgtgggaaagtcaccatcaaggggaagcggcactggtacgaagccctgccccaggcagtgtttgtggccctgagcgatgacacggcctggatcatcaggaccagtggggacctatacttgcagacaggtaaccgcgggccacgcttagaggcctgccagctctgccgtcactgcctctgctgcaccctgctttgctagtaacatgcttaccacaatcrctatgattaagaggctaaatccattcgaattaagacacttctgggaagagagtatttgccatttggcatgtattagcagtttcctgcattgacacaaactcaacccaggacaaatttagggcaaaaatgaataggattatttggtgagatacagaaacagaatcttattctcctatggccaaccaccgcatatcacgtatcctacaatgttagatcttaagaggtaagaatacagaggaaggacataaaattcatttccccctttaagctaaagtttaagtggctgcattttttttttcagccatatcaaagcccggctcctatatacttacttacccgtgggccaggaaaaaaaaagaaataatttgctcttttttattttgagacggagtctcgctctcttgcccaggctggcatgcagtggtgccatcttgactcactgcaacctctgcctcctgggttcaagtgatcctcctgcctcagcttcctgatcacaggctgggattacaggtgcccatcaccacgcccagccaatttttttgtatttttagtagagatggagtttcactatgtcggccaggctggtcttgaacttctgacctcaagtgatctgccygcctcagcctcccaaagtgctgggattacaggtgtgagccaccacaccaggccataatttgctctaaatagcagttcaggccaggtgtggtggctcatgcctgtaatcccaacactttgggaggcctagacgagcagatcacctgaggtcaggagttcaagaccaacctggccaacatggtgaaactctgtctctactaaaaaaaaaaaaaaaaatacaaaaaattagctgggcgtggtggcgcttgcctgtaatcccagctacttgggagcctgaggcacaagaatcacttgaacctgggaggcagagcttgcagtgagctgagatcgcgccactgcactctccagcctggtgacagggcgagactccgtctcaaaacaaaacaaaacaaaaatagcagttcagcaagtcacaggaagctgccctcagggaagtttttagctgatggaagggcacagtgggacttgcttattaaaaataagctgtaatgacagtcagtgtttactgtcagcagaatggggaaggatcttccaccagcaatgtgatttatcagtatctggaaggactgtggggcaggagttatcgtcagttgtccagaggccacgttggatttatgtaaagatcagtcttccaggcgtttaatgttgttgattccaggagaatgttgttgttgttgttttgagacggaatctcgctctgttgcccaggctggagtgtagtggcacaatctcggctcactgcaacctccacttcctgggttcaagcgattctcctacctcagcctcccgagtagctgggactacaggcacatgccaccatgtccagctcacttttgtatttttagtagaggcagggtttcactatgttggccagtctggtcttgaactcctgaccttgtgatccgcccgcctcagcctcccaaaatgctggcattataggcgtgagccaccggcctcaggagcatgttttaatcactgctgtgagtcgtcagctggggatgartcttcaggttgaagctcttgcacagctggctctctcctagctgtgtaagaacctctggcctgggtgcacagccatgctggcttcataggccatatgctggcccaggtctctccagcctagttcctgtgtctttctttaaatgaaagtagctctgtcaaggcacatgcacatctaagctgccaggacatttgagctttggtcatggggaagacaggaggtgcttctggcctgggggtgaggagcgagtgacctctaaaccagtagtgccagaggaatcaccaggacagtgatttcacatgaggtggccccacccagacctgttggattaggtccaatccctctggagactgctcaggagtgtgtcgtgtaagaagtcctgccggtgattcccacctagtttagtggaaggaaatatcacccaaggactgcaatactataggtgcgtctgtgattagtcacggagcatatttgagtactgagacctaattgcaggcctaaggtcaaggaatacagggttgtaggcgacagttggtctgtctgctcccctgggaatagcctttgagctcatttagacatactttattgacagaacacaaggaggcaaggggagagccctggacagggagccagggaccctgagctttggcctgccactgccttgcagtttgacagacctcagatttcatctgggaaattcggggtttcattttattagtggaacctcgcacccagtcagagcagagaggagccgccgtgctggagctctctgcaggaacgactgcaggcctcaggtccctgccaactccagcagcgctgcagccctctgcctggaagagctgctctgccctgcagcctttgggcctccatctggccactctcctgctcttggcttttgtgttcttctcttagaacttcttaagctacattgggacaccagataattctgaattgttcagttttcaaagagtgtctaaaactgttttcagatagatgttacatttaggcagaatttaaccactttatgttgattaaacttgacaacaaaaaagcggccggacagggcagctcctgcctgtaatcccagcactttgggaggctgaggtgggaggatctcttgagcccaggagtttgagatcagcctgggcaacgtagaaaggccccgtctatatttttaattaattaattaattaaagtttttttttaaagcactcatcataaaagaatayagcaaaataccaaaaaaggaaaaataagccaataaccaagtcaaaatgaggtgtggagttctgactgtgtgtctttggggcttcttcccatcttcctggcaggtctgagygtggatcgcccttgtgccagagccgtaaaggtggactgtccctacccgctgtcccagatcacagcccggaacaatgtggtgtgggcgctgacagagcagagggccctcctgtaccgggagggcgtgagcagcttctgtccggaaggcgagcagtggaagtgtgacattgtcaggtactggcgggccagagactcctttcacatcgtgcttgtcctacycttcgttcttgtccacttgacaccacaaggcaccatgaggccgttcctgggaggcagcacctgcagcctccatggctataggctaagcttgaatctctgcctaattctgaccggcaaactggacgttgagtcagagctcgctttttaaaaatgctgccgccctctgcgcagccctgagcatcacagcgtcatgagtctgtcatgacggtctctrttcagaattgcccaccgtcaggtagttctggtttagtgtctgtgacggcttaggtccaaatatttttctttattttcatgctaatcgaagttgatctctgaactgtagcttttttttttttttttgatacaggttctcactctgtcacccaggctggggtgcagtgccacgatcacggctcactgcagccttgacctccgggctcaggtgatcctcctgcctcagcctcctgagtagctgggactacagatgcatgccaccatgcccagctaatttttgtattttttgtagagatgagttttgggttttcatcatgttgcccagactcatctcgaactcttgggctcaagcaattctcctgccttggcctcccaaagtgctgggattacagacatgagccactatgcctggcccgatctctgaactgtaatttattaagctatttttttttttaccattcaagatgttagttatagaattgccatcagatcattttactagtatggaagtattaatagtcctttgaaaaactagattaggatattcttggtttgaatttagcaagccaataaactttcagtgaatacctattaagagccagaatggtccaggtgtggtggctcacgcctgtaatcccaacactttggaaggccaaggcaggcggatcacgaggtcaagagttcgagaccagactgaccaacatagtgaaatcccgtctctattaaaaatacaaaaattaaccgggcatctcaggaggctgaggcaggagaatcacttgaacctgggaggcggaagttgcagagagcygagatcgcaccattgcactccagcctgggtgacagagcaagactccatctcaaaaaacagacagacaaaaaaaagcaacaacaacaaaaagccagaatggtgctaggggctgggtgcgccaagagggctgagactggccctgctctcatcagttccaagtctcatgggggccccgtgcatggatggacacccattagcacagatggccctaaacaggagtgtggagcatgcagcactgagggaaccatggactccatgcagagatcaggaaggcagcrtgcagagtggaccaacagctaagccttgaagctgacgaggacttccccatatggaaggagggggagggcgtctccagcaaagagggcagtgtctgcctaggtccagctgcacagaatagcctggcacatcgggggagtttacagtcattcccttggtgagggagggagtagagagatggaggcgctcaggggccttggattggcgggggaaggagtagagagatggaggcactcaggggccttggattggcgggggaaggagtagagagatggaggcactcaggggccttggattggtaggggaaggagtagagagatggaggcgctcaggggccttggattccttttgtgcctactcgcttttttcttaggttattttctctcttaagagtgttcccggccatcctgggtcatcagtgtgtctttcaaaagctgccacccacttgaaccatatctcttgcacagtaatttaactcagasycaaacttccttccctggcacctgctgatccgctccagggccacgtctcttctcccagccacgcctgccgggagaccctggatgtccgcagtccagacacactgggcactctgcctatgggtgctgacccccctgttctcctccttattttcagcgaaaggmaagctttagaacccgtctgcataacgctcggggatcagcagactctctgggccctggacatccatgggaacctgtggttcagaactggcattatttccaagaagccccaaggagatgacgaccattggtggcaagtaggtgttcagctctgcgccacgtgccgaggtctcccgaccttttctgcttccccttttcttacttctctcttttccttaacgatactagattaaatttaaaatactcacttttttattatttgtttgtttgttttgaaacaagatctccttccgtcatccaggcggaagggcagtggtgcagtcacggctcactgcagtcttgacttcctgggctcaggtgattctcccacctcagcctcccaggtagctgggactacaggcgtgtgccaccatgcctggctagttttttgtatttgtttgtagagacagggttttggcatgttgtgcaggctggtctcaaactcctgagctcaagagatccacccagactgggcagagtggctcacacctgtaatcccagcaatttgagaggccaaggcaggcagatcactcgagtccaggagttcaaagccagcctgggcaacatggtgaaaccctgtctctaccaaaaatacaaaaattagttggacatggtggcacacgccgttggtcccaactactcggaaggctgaggtgggagaatagtttgagcccaggagacaaaggtttcagccaagatcacaccaccacactccaacctgggcaacagagctagaccctgtctcaaaataaataaaaataaaaaagagagagagagagaaatccaccctctccgcctcccaaagtgctgggattacaagtggagccaccactcccagccaatagtattccttttttctatttgatggattagactttgctgtgtttgagtgcattagaaacataaaggacttttcatcataggaaataatttgcaaactctttgtgtaaataatgcacttaatttatttattttgatattgtttatatatttattattataggctaaataaacccagtgacatccatttgaagacctaggtaataatgatgtttaattatgaacaaatgtgctgagaaaagagcccagataataggtttgaaagcccaacccagaattaaaattgagctgtctctgcttattcagaaggcctctaagtagatggtatttcagcaaagacaggagaattttcccacgtgcttccagaaaaggaaacactataagaaacaggatgagggtataatcaagctcactgtgtgtgatttggtcccagcaagagcgcctagaatgaatttctcttttctttttcttttctttttttctggggcagagtctcactcttttgcccacactggagtgtggtggcaggatcacgacccacctcagcctcccaagtagctgggaccacaggcacatgccaccatgcctggctaattattttggtagagacaaggtcttgctgttacccaggctggtctcgaactccttggctcaagcaatcctcccaccttgacctcccaaagcgctgggattacaggtgtgaaccaccaccctcggccctagaatggattttcaaaggagtgtctactttccccttctttggtatagtttagtgttagtgttgctcccacagtctcccactgtggtaggtaagatttcactgatagtcgatggtcgtgaaatatttgatgtttcttttttttgagacggagtcttgctctgtcacccagtctggagtacaatggcgcaatctcggctcactgcaacctccgcctcctgggttcaagcgattctcctgcctcagcctcctgggtagctgggactacaggcacgcaccaccaggcccagctaatttgtgtatttttggtagagacagggtttcaccatgttggccaggttggtctcaatgtcttgaccttgtgatctgcctgcctcagcctcccaaagtgctgggattataggcgtgaaccaccgcgcccggccagtatttgatgtttctgaagtatcttgccccattggtttatgttttattgtcacctcagacttgctttgttgaaggcttgtcttgcattgactgctctgaggtctttcagatgagaatgtagaaaaatgagttgtgtttactctttgataaaatatgtattctatataatatgtacattatatacagatgtatctaatttatatactaggtaatatttgatagtcatgcaaatgattttaaaataccttttgtgtacttgtaaccatatatatacatatacatgtaaaaatatacatatatgtatttttgtagagacagggtttcaccatgttggcaggctggtctggaactcctgacctcaagtaatccacctgccttggcctcccaaagtgctgggattacaggcgtgagccactgtgcccgaccaggagtagggcatttatgccagtgatgttttatgtaatcaaacccagcagggcagaaatgtgagtgaacatcatggagaatcagattttcactcataaagaatttgccttatatcaagctgcccaagaagagaagagcttcctgcagggaggggtggttggagaaatgtctgaggtatatgaatgcttttcaggaatgttatagaagcaagctacccttctgagctagggttagagtctagatacccaggatggtcctagttgatgctcttgccctggagtaattattagtagtcccaattcagatcataaattagttcatcacagccttgcatggtggctcacacctgtaatcccagcactttgggaggcctgggcgggcggatcacctgaggtcaggagttcaagaccagcctggccaacatggtgaaaccccatctttactaaaaatataaaaaattagccggctgttgtggcgtgcgcctgtagtcccagctactcgggaggctgaggcacgagaatctcttgaacccaggaggcagaggttgcggtgagccaaaattgcaccactgcactccagcctgggtggcagggcaagactatgtctcaaaaaaaaaaaagttcatcactctacttgtgatacctttttagatgcatattatgtttctaagtaccgtatactgttgtccattggaaatacctgatttaaaagcaaaattaaagctgggcatagtgkttcatgccagtaatcccaacactttgggaggccaaggcagggagatcacttgagcccagaagttcaagaccagccctgggcaacacagggagacctgtctctacaaaaaatttaaaaattggctacatgtagtagcattcgcctgtatttgggaggctgaggtgggaggattgcttgatcctggaagtcaaggctgagtatgattgtgccactgcattccagcctggatgccagagcaagactgtctcagaaaagatggcaaaattattctttctcactctgattagaatgaaagtcttcttagaaggggtgtgagggggtgataatcacaaaagtaatacatgcttgtaacagatccatgttgtataaaagtatataaaatgtgaatatattcttccatacctttaaatccaaccctacgaaggagctggagttagcattagcagtttgatggcatcctgccacatttttttggtcctttcacaagcgcacacgtgcacatttgtgtttggatggtcatcttgttactagaaatgcagaggtgtggacctgagctagaaccttccctcaagrcagagagtctacacttgtaactgctctgacagcagggcttttgcttgtctcctccttccaggtgagcatcacggactatgtggtgtttgaccagtgcagcttatttcagacgataatccatgccactcactcggtggccacagcagcccaagcccccgtagaaaaggtggcagataagctgcgcatggcgttttggtcccagcagcttcagtgccagccaagccttctcggggtcaataacagcggtgtctggatctcctcgggcaagaatgaattccacgtcgctaagggaagtctcataggtgggtgaattgctgtaattttcacactggctttataggcagcctcactttaaagccaacatttaaagaaaagctttaagatctcaacttgaaaagataatttagtgccagtggtatgaagtgtctagtggaggcactctatgctttgtgatcagtttctctcctttttaaaaaatctgtcattcctaaaactcgtatccctgtgtctggatagtgtttcccctggaaaccttttatgacataagaaaagcaaatggaggtcatttttatgttaacaatttcacattttaaatgaaaaaatccacccaaacctagtgagagagaatggtccacttcctggagggaaggtgatcgccactgttggaaatgcaaggctctggccaggtctgtgaatgtagatgccagtctacacatcctggggtttgtttctgtgagtgaaccccttgcttttctccagccctctccctgctgcatggcctccacgaccctggactgggtgtggctctgcctggcagtattcagagggagatgaatgttaggctgtgattgctcatgtcgctttatttagggacacyctagaattatctggagaaagggtttgaaggccagctgtcgtccagaactaagatctgaagtggttttgtctatgctttctttctttaacacattcttcctatttactctttccaggcacctactggaatcatgtggttccccgtgggacagcttctgctacaaaatgggcctttgtgttggcttctgcagctcccacgaaggaaggtgggtcagtcttagcctcactgaagaatctagagcacagcttggccattggaaaggttcaaaccacagtcggactgtggccttgttggttatggggcatgcctcggagactgaccacgtgagggtgtcagaggccagtagcccttgttagctgagccgagggccctgaatcgggataggcctgaccaggagagcctctgagagggaccgagcgtggtgaagatgagggaaagtgtccttctgaaggaggggctcacacagtgcagccaccggggctggcagctggtgacttccagtggcacatggcaggggccacagcttctttgggcaccttcccatctcccctcgagaatccttctgtcacctcccagcaacttccttccgtcttgttcacagcctccggataacctaagtccgacatttgcaccgcattaggcagacctgccctgcagcggggtgctcctgccaaccacattctgggcagaactcagtgtccctgcggagtacagggtttgtgagggagccagggcaccagagggtgagggagctggcatctgcggccgggaggggcacttcccccacccgcttagctgggagccccggcagtcaggcgacctctctgggaagtagctgtacctcctcccaggattgcctgaggatgaaatgcaaagatgctgtgaaatctgtggtgaagagggaatcgtttgcttagttcaaaccattagtcccactaggatgcaggtgactgggtcagtacaataacttcttactcaccagattgttcggaccacagttctggaacccagaaatctctgaaaacaatgttatttcttgagtctggcataaattaatttggcagcaaaacctgaccggatctcacatagctgcctccagccttggttgatctgttggctgtgaccgcatccatgttgcagggatgttaccgcacttcaccggggagcgcctggcccctccgtggttgttttgtaaacctctggcatacccattagcttaggttttcaaaaatccagaaaaagtttgaattccaaaacgtggccacaagttgtagataatacttcatataacgtactgtgaccaagattttaactgccctaaggattatttgcattttaaacagaatctgttaaacctaaaggacttttttaaaatgctgtagggaatgaaaggacatgattttgaggcaagggtgggaagagaagcacttccagcttcctaagccttctccagcagctgccccaccccccggccccatccccagaaggtccgggagagcaccatggcgccatccttcctaggaactgccaaccctccctccctccagggcaccgagttgatagtcttctcctcttggtaaaattaactttctacattaaaaatgctttggtgcctttgttcaagtgaaaaacttctcagcccatgaaaaatgggaggtcaaagccactaagccaacattatggccttcataaaatctcctaagccttgccttctttccatttctttccaacatctcaggcgtgtttcttgttagtcacggtgtttccctctgccttctaccttaaagtgctacaccgctcctgcccgtgtgggaatgggcaggtgagtgagctggcatctgtggccaggtggctagcgtctgctgaaaggcaaaggctgccttgtgcatttagggcaggcggctyggtgcagacaacacctcgatgacaaacatgacccctttctgcaggaagcttcctgtggctgtgccagagcagcaaggacctgtgcagcgtcagcgcccagagcgcacagtcgcggccctccacggtgcagctgcctcccgaagccgagatgcgcgcctatgccgcctgccaggatgcgctgtgggcgctggacagcctcggccaggtgttcatcaggacgctctccaagagctgccccacgggcatgcactggaccaggctggacctctcccagctaggtacggccacctcgtgagtacacctgccggtgccctgactgccctaaaccggcatcacaacgtgatgtcggacaaaactgccyggcctgtgtccaacctgtgagagttctgagggggtgtttataagctgctgaatttcaggagctcagttggccactctttcagactagacaggctctgggttttgtcccttcccctgccccttagagtttgcagggctgtcagaacccgaggagggtgtgcgtcctcaggtcaaggggccactcgctgcgagcggcttgaaggatactggtgatgcagctgccccgtcagtctttctgaatatggaacatagctttatgacctgaaaagctgaaaagatgggtgttccctatgacaggatcagtgccacgtttgtctatctcctcaggacagtacctggcggaggagagtggctcagcacacaggtgctagctctccttcagctcagccagatataggaggacctgcatccactagctcctgcttttctctgaatcttctatcaaaagccgtggagtaggctaagaaatgtagtgctatttgtaggccgggcgcagtggctcacacttgtcatcccagcactttaggaggctgaggtgggtggatcacctgagatcaagagttcgagaccagcctggccaacatggtgacaccctgtctctactaaaaatacaaaaaaaaattaggtgggcgtggcagtgcacgcctgtagtctcagctactcaggaggctgaggcaggagaattgcttgaacccgggaggcgggggttgcagtgagccgagatcatgccattgcactccagcccaggcaacagagcgagattctgtttcaaaaaaaaaaaaagaagaagaaagaaagaaatgtagtgctgctatttgtaaataattcattcatgttccaagaaataataacataagcccacaacattagatttctctctgagtagattcttggtggatcaggcagcataggtgtggtttgcctgaaggtggagttgtgcagatggcccccagggcccggatgagccctgcacttgcagcaggactgacttaggaacttcctggctgcaaggcttcccagtttttttaacttagaaccagcatttggttatgtggtagacttgaattgtataagcatttaatgtttgaaaactcaatcacatgtactcaccaaaaaaaaaaaaaaaaaaaggatggggagaaagaaagcaagaagagggctgggcacagtggctaatgcctataatcccagcactttgggaggccaaggagggcggatcacctgaggtcaggagttcaagaccarcctggccaacatggtgaaaccccgtctttactaaaaatacaaaaattacctgggtgtggtggcacatgcctgtaatcccagctacttggttgggaggctgaggcacgagaatcacttgaacttggtaggcagaggttgcagtgagctgagatccatgccattgcactccagcctgggtgacagagcaagactctgtctcaaaagaaaaaaaaaaaaaagaaagcaggaagagaagggcttgttccccttctccccaagcccctggctgcattgcagtctgtatgctaccagctgatgagagcctcttgccattccgtaaagcaagcatcgtcctaggctgcctggcagtggttggcgtgctcagccccgggggctcctacagggtgctgagtagacatcacccattcttttgcctgaaaaggcccctgaacactaactcagctgaagaagcaagttctgttccaaggcttggggactgaaggtttgtccagggcaacttttgttctttatgctttgggcctccccacctgccttttggacccaccagtcaccatctagctttttgagaacacccgcctctccacatcactgacagtgactgatagacaaggctgaggctgagagtggcctgaacattggtgctgactgacctgccgcctgccctggaaagcctttcatttgttcagagaccctactggtcctgagccattctccagcagctcctacccagactaactggaaaatgccgctagttccctctgagggtaaaaagtccagggcttggtgtgtattctccctgctcctgaatcttgagcactgtgggaggctgtgttcacctgcaccatttgggtgagaagcagaactgcttcccttgcacgtccccttcccagcccctccaggaaggctgctgcaccgtggtgggattcagagtgaatgggcatcatgccaggttctgcactgctggagccagccctgcctgggcctcctgcctccagcacagctcatgcctccctcctggctcgatccagtcctcccagcaccggctagctggccaaagtggtgcaggtctctaaggtgtgtatttgggcttcactgggaggtttctctcggggagaaacctggcttgagtgggattgagtctcaagagtgtgagggaaacaggaacaagtccatcctgagtccaagatggccttgggccatctggtgttcagcagatactcattgaggggttgggtgtgtgaacagagggatggcctggggatcctggtcgctgtggatgggcaggttttcactgacctcctgtgttccgcctgcaaaatcattagcaaatcaatgtcagtatccggctgaccccgaaatgaatcagacagcagtgggtgcaaggaggtcacaggcagaggtgtggggactcatggcagaggcaggacagagctgggccccaggcgggctctggactctgggcaagctgctgtcaccttgaaccgcaatttcctctcctttcttttttttccaggtggggtctcactctgtcatccaggctagagtgcagtggcacgatcttggctcactgcaacctctgccttcccaggcttaagcaatcctcgcacctcagcctcccaagtagctgggaccacagacatgtgccaccatgcccacctaatttttttgttttttgagacggagtttcgctctgtcgcccaggctggagtgcagtggcacgatctcggctcactgcagcctctgcctcccaggttcaagcaattctccctgtctcaacctcccgagtagctgagattacaggcacccaccaccacacctggctaattttttgtatttttagtagagacagggtttcgccatgttggccagtctggtcctgaactcctgacctcaggtggtccgcctgcctccgcctcccaaagtgctgggattacaggcgtgagccaccacgtacagtccctgctaacttttgtattttgggtagagatggggttttatcatgttggccaggctagtcttgaactcctgacctcaaatgatccacctgccttgtcctcccaacgtgctgggattacaagtgtgagccaccatgcccggccttggtttcctctcctttctaatgggagcagcaacccccaagcccaaccccctggaggatgcacggggcatcccgtctaaatgttggccatctccgggcggtgtggtcatcctaaggctgtgacacgtcttgcttgggggtgctctctagtctttgttagctgctggtggtggggcttttgcttgtgttgccccagtttgtgccacagggaggacaaatccagcatctcttgttaaagcaccacctcgcttagtccttatcctgccctgaactttagattttgtttatttgagttatctggttgatcttgaaatgtcagattaagactcctttcctgtttcctacacatcctgagagaatgcagcaagtccagggttggcagctttgtgttggggcaagggaggtgaacaggcaaccgggactcccaggctgttcctctgcacacgcacctatcccctcaacgagtatctgctgaacactggagggctcgaggccatcttggactcagggtggacttgttcctgtttccctctcgctctttttttttttttttttgagacagagtctcgctctgttgcccaggctggagtgcagtggcgcaatctcggctccctgcaagctctgcctcctgggttcacgtcattctcctgcctcagcctcccgagtagctgggactacaggctcccaacaccacgcctggctaattttttgtatttttagtagagatggggtttcaccgtgttagccaggatggtcttgatctcctgacctcgtgatctgctcgcctcagcctcccaaagtgctgggattacaggtgtgagctaccgcacccagcctccctgtcactcttaagttgagactcaatctcactgaagctgagtttctcccctagaaagaacagccacctccccagccttcactatgccagggtaggggcagtgagcatcaggccaggggcaccaggtgttcagttattaggctctctccaggtatggtctgtgtcctgcaggaaaagcaggtaggtcaagagacttctctttttgtttgtttgagacagagtcttactctgttgcctaggctggagtgcagtgacacaatcttggctgactgcgacctccgcctcctgggttcaagtgattctcctgcctcagcctcccgagtagctgggatgacaggcatccacagccatgcccggctaatgtttgtgtttttagtagagacggggtttcaccatgttggccaagctggtctcgagctcctgacctcaactgatgcacccgtcttggcctcccaaagtgctgggattacaggtgtgagccactgcgcctgacccaagagaccttttaataattacttatttaagtgaaaattttgaatgcaggtgtgctgtctgcccaggagcccgtgtatgactgtgcatggyggctgtcatcaggtggcatgcattgaatggggattattgactgtaaaggagagtcatcaagctgacatggctgctgcctgtgttacttatctggaattaattggggtgcttcatttattttttacaagtcagcagtgggccgggtgcagtggcttacacctgtaatcctagcactttgggaggactgcttgaggccaggaatttaaaaccaacctggccaacatagcaagaccccatctctaaaaatatttgttaaagtcaacagtagggggtgcacacagcaatgaatggaaacacagtgactgcatttgaggatgttgttcaatatcaaatttagcctcccccaattgtgctcttcttcctaacttcgctcctctgctcccactaaattccctttttttttttttttttttttgagatagtgtctcaccatgttgcccaggctggagtgcaatggtctgatttttgactcactgcaacctccgtctcctaggttcaagcgattctcctgcctcagtctcccaagtagctgggattacaggcctgtgccaccccgcccagctaatttttgtatgtttagtagagacggtgtttcactgtgttggccaggctggtctctaactcctgacctcaggtgatccacccgcctcagcctcccaaagtgctgggattataggtgtgagccactgagccctgctgctcccagtaaattctgctggaaagaccagagtgctcttttggccagtcgctcagcagtgtcctggccatctacccgaggatctccctgcttctggacctctgcttccctcccaccactgtcagggtggagccccctcgtcaccaagttgctgtactgcagtagctgcctcctggcaccaggtgtgcccacctcccaccacggctaccagagctgtcttcctcaaacccagctcagatggtgttgccctccacgttacatggctccacgctgccactagaatacagctccagtctttggtgtggcacccagggtctcgcagccagacccggcctgctgttccgaggcctcgtgcgttggggactccagccactcctggcctttgtgttggggccctggctaactttcatattttgggtagagatggggtttcaccatgttggccaggctggtcttgaactcctgcccttccctaatgtgtggtgcatgttcatgccacccatttgcttctcttcctggggcctagcattccttccgtgggctgctttccttcaactcttcttccttcaggactcagttgagatcgcacctccccaccagacattcttcattgactgtccccatcatagcactgtgcttctacctgtcatttcagagccaagcacggtggcgcacacctgttgtcctagctacttgggaggctgaggcaggaggattgcttgagcctgggaagctgagcctaatctaggcaacagagcaagctcctgtttcttaaaaaaaaaaaaaatacacacaatatatatatatatatatatatgtaattttagtttgactcacattatttttgttgaaagtttacacacggagtgtgtagggactttacaggcagagaccaattgcttggtgacagtacgtacccaacaggatttttgttttaatttgggatggggtctcactatgttgcctaggctggtctcaaactcctgggctccagtgatgctcccacatcagcctcccaaagtgcggggattacaactgcatgcagctgcaccagcaggatttaaaatgtcagggaaagtcagtactgtttgcagctccatttctgagtaactctgggatgtgagttttgatcctatatttggccatgttactggtagtcaaagataaaactgccttccatgcaagtacaggatgtcatcacacacagtagcctggtggatgatgtgactcccaccctcccaggaaaattctcatctcttgctctaagttgccatcagccttcccagggcatgaggcagaagatgttaggttataaaaacttgtcggccaggcatggtggctcacacctgtaatcccagcactttgagaggccaaggtgcgtagatcacgagatcaagactatcctggccaacatggtgaaaccccgtctctactaaaaatacaaaaattagctgggcatggtggcttgcctgtagtcccagttactctggaggctgaggcaagggaatcgcttgaacccgggaggtggaggttacaaagatcatgccattgtactccagcctgggaacagagcgagactccgtctcaaaaaagcaaaccaaaaaatcttgttagagatacatttacatgtgttctcccttcagccctggtgttttctttacaagtgtcttcctggttgtatgagtagcaagcagccttggacagcatgacctctgctccctcggggacagtgttgaccttgggcagcactaactcattgttaggtcaggaccatcatcagtcttctctaaaaggcaagcagaaattttaatttcagactgggtgtggtggctcacgcttgtaatcctagcactttgggaggttgaggcaggaggatcacttaaggccaggagtttgagaccagcctgaccaacatagcaaaaccctgtctctacttaaaatacaaaaattagctgggtgtggtggtgggcgctgtagtctcagctactcaggaggctgaggcacaagaatcgcttgaacccgagaggcagaggctccagtgagccaagattatgccactgctgagccaagatggtgccactgcactccagcctgggcgacagaatgagactctgtctcaaaaaatactactaataataatcaattaattaaaaaacaaggccaggtacagtggctcatgcctgtaatctcagcacgttgggaggccaaggcaggcagatcacctaaggtcgggagtttgagactagcctggccaacatggtgaagccccgtctctactaacaatacaaaaattagccaggtgtggtggcacatgtctgtaatcccagctacttgggagcctgaggcacaagaatcccttgaacctgggaggcagaggttgtagtgagccgagatcacgccactacactccagcctgggtgacagagcaagactctgtctcaaaaaaaaaaaattaaattttaatttcaaggatgaggatgactttagcgaagtatcaaataatgaacatgatttctacctttaatttttttttttttttgagacggagtctcgctctgtcgcccaggctggagtgcagtggcacgatctccgctcactgcaagctccacctcccagcttcacgccatcctcctgcctcagcctcctgagtagctgggactacaggcacccactgccatgcccagctaatttttttgtatttttagtagagatggggcttcaccgtgttagccaggatggtctcgatctcctgatcttgtgatccacccgcctcagcctcccaaagtgctgggattataggtgtgagccactgcgcccagcctcaattttttttttttaaatacagcttccctcttctttctacccctatacaaattaccagagcaattactgctataggattaaattaaaggaattcttaaattaaatggttggctgctgaaccaagttgtagcagttgaatatggaattttgtagtgatttattataatcctagtttttggaagaaaatttgcatcacttagcagatatttaagatgcttgtaacatttcatttcccagtacacataaatatgcattatgtcaggcattggaatgtttagcaaactaatgaaatttgtaatttaatttatcaggtcacagcatttaatgaagaactattcagtgtcagtttatgccgttaggtaacaaacaggattgtgttacgcagtaatttatacagaaaagtattttataaataaaatgtcaaataaatgccactttttgttttaaaatgatatgtttaagaaataatcctaaagggaaaatgtctgctttgtcgaataaagtaattaaagcatttttttaaaacaagagaaaaaaataaggacaaagcagggacagacaggaaaatgtcagtgtgtttgcatcagccaggctgggctgtgcttcggtagcaagccccagatatcagcgacttcacacagtgaaccgtggcccccgctccacgaagctggccctgcatctgtcctcttctagggcagtggtcctccaggtggtggcttcctgatcctgcctgctttgctctgcggctccaccatctcggttccttctgctcagagcctgttgccagtactggtcgtgggtcctgcctaactctaagggaatgtgagggagccatggagtgcttggggagggctgtggtctctgccaccgcgttcaccacatcctgaccacttcttccatggaacaggttcacaaacctcattcatccaggcggcctgggtgacactctggggtaaaagtctgcaggaaagccctcagttcaactttgtcatctttcacctgtctcttcaattcggaataagctggtttatgcactggaagtacatcatctagtagtcttttatatgtgttctgaaaggttgttcactgtgtaatgtgaactccgtgttctgtgagcagtgttgttgctgccaactctgagatgctggcctggtgtgtttttgtcaccatgtgactctgttagcatgatcactgctgcctgtagtttctcttagaggcaggttgaagactctaatgtaaaattgtcttttaattagcatttgtttctcagctatttctagagttactgttgaaggtactttattttgactggtacagatctttgcatatgtaatgttagagttccagggaattctgtttaaactccccggtaaaacattctgtacaagatcaaggaaggagaaaatacagttaatttttggaatagagaaattgtcatctttagaaaatgcaaagaggaataatgataattttttgtgtagcagtgaatgaatagctttaagttgatgtcataactgaagacacatgagattttcacatggcagagtcatgcctctgtgttttgctacactccgtgggctgtcatctgataccagtgacaactgtgcaagggtggtacctcccgattctgcacccagtgtggggcgtcctccacctgyccctctccagcagcaccaccagctaatggagctgcacaccttttattccccggttgaaagtcaaaataacccatcaaaattaaaaacttctcatccaaaaacactattaagaaaatgaaaaagcaaaccacagactagatttacaatgcacgtatctgacaaaagactagtacctacaatgtgcagagaactcctctaactcagcagtcaggagaaagttcattttaaaatgagcaagacttgaacaggcacttcacaaaagaagatatacagatgtccataagcatattaaaagattcccagcatcattccttagcaggaaatacaaattaaagccacgacatgatacaacttcacctctcctagaatggctgccgtggaaaaggttcaggggtgcgggcagccagaacccgcagacacggctgtgggtgtggagcacaggatctccattggggaaactggcggtttctttaaaaatgaaacaggccgggcgcagtggctcacrcctgtaatcccagcactttgggaggccgagacggatcacctgaggtcaggagttcaagaccagcttggccaacatggcaaaaccctgtctctactaaaaatacaaaaattagctggacgtggtggcaggtgcctgtartcccagctactygggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaaaaaacaaaaaaacaggaggcagaggttgcagtgagccaagatcacgccactgcactccagcctgggcaacagaacgagattctgtctcaaaaaaaataaaaaagcagtcagttcagcagttacctcagggtagagggcattggccagaagggagttgagggaactttttggggtgactaagttgtttaaaaccaattgggacaggcgtagtggctcacacctgtaatcccagcacttcgggaggctgaggtgggtggatcacttgaggtcaggagttcgagaccagcctggccgacatgattaaactccatctctactaaaaatacaaaaattagctgggcgtggtggcacgcgcctgtaatcccagctactcaggaggctgaggcacgagaatcacttgaacccaggaggcagaggttgcagtgagccaagattgcacccctgtacaccagcctggatgacagagcaagactccatctcaaaaacaaacagaacaaaaaacaaaaacaaacaattcaacttagccctgaagatctgtgcattgtgctgtaggtaaagtctcagaggtcagaggttgctgatgcagaggacccaggctgacccaggtccaaaccttagatcctcctttgcctcctggcctggccacctcctgccgtgtggccctcagcagatctctttctggctgagtcccgacggtctcatgggtgaagtgggatgatactaatcgtgtatcattgttgtgggtttgagatgagtatatgaagacctggctgacagcctgtccacagcagctgctcaggaactgttgactgctgttcttttagccagactattatcaaatgtaatttctatttttaaaaaactcttcccatttcctttcctcttgcaatcagtctcaatagcagtaagaaataaataaaaatgaagattctttgggagacttagttttgtttttttttgtttttttgagatggggcctcgctctgttgcccaggctggagtgcagtggcaccatcacaggtcactgcaacctygacttcctgggcccaaccgatctcagcctccygagtagctgggactacaggtgtgtgccaccacacccaactaatttctgtgtattttgtagagacaggatctcactatgctgcccaaactggtcttgaacttctgggctcaaccgatccacccgccatggcctctgaaagtgctaagattacaggtgtgtgccactgtgcccagtcagtttaattctaattaagatcaagattatctgtaaatacgagttccctctctccaaatctagaatttgctggcattagtcacatgtctgaggaagctgacgatgggacccacattgagatactaatcccagggctcggtggttcagggcactgtactgacagcatcttgactgctttgcctgttgcctggaaggggtgccgtgtggcgcctggcaggtggcagagtggccagaggccattattactctcttgagttacggtgttctcaagcccagctgagtccacacagccgatgtggatggactaggacagatccgatgacttagtgtccaagttcarttgcaaatgcagcctcatttctttctttgaagtagaaaatcaaagttcatagattagrtgaaagaatagtcattgtacaaaagtaattatagtgtgtgtacttttctttatctacaggagctgtaaaattgacaagcttggcatgtggaaatcagcacatctgggcctgtgattccaggggtggagtttacttccgtgtagggactcagcctctcaatcccagtctcatgcttccagcctggataatgattgagccacctgtccaggtaagcagaagttagctggtggaactcactcttcagtaagacagaaactgtgaggatgctggtactgggaaaaaggatctgcacagcctctagaggcctcccagcaaatgcggggagccatgcccccagggtctacacacwctcgttcatcaacatcacaactggaattcgggatttgtgaagtttagagctgaacagactgttacagattatgagtcaacacgtatattttctctttcaaaataataatatttcgtttttgactttttactaagtgaatattattttttaaatctgcctatatattggaacctctattttataataataatgataataaatcagtacccagaagtataaagaaggtaaaagttactttgaatcttgtcatggagaaaatgctgagtgcctctcctggtttgttgaagaaattccgtttcctgtccagcccactgctggccagctcctgccatgtttcagctgaccgtgcatcccaacacagagtctgtgttctcctgacctccagcactcagctcacaaggagaagtctgatttgaatgtactatctagttacccttaaagatcccacaggcttggttcctgtgctgaatagatttctgttgaagtttataactgggggctgtggttttttgagacttatttgcccagactcctgccagcccccatttggtgactctgttgggaaacaggtgaagttgccaattgtggaggcagcagtggggcaggggggatggttcgttgttgggcagagaaaccttcagtggagtcaggaaagaggtaaagagtagggtaaatgcctctgtgcataactgtctacattttggtcatggtgaggcctcagggatgaggacaccagtggtgtccaccagccctggggagtgtggtggtgggagaacctttactgaaatcagcattcggctccagagctctgtggaggccaccactagcggtcatggccacagggaggcttctcgtcctccttggtgggtcttcctcctccagagggtgatggggatgatattgtctatgacaacactttgtgaatgatacggcactgtcaaacatgaggttgtacataatgaattataacacatgctctgttttccctctgcacacggtgacgtactcatagtggcacagagggagagtccaccctgcagagaggagccttcctcactgccatgtttagcactgctggggcacagtgattatgaaaagcaagccgcctgtcgttagtttcattattgtccttaaattctctggttgcccgcacccaggtggactcctttgacacaccactgtcaatacgttcctttttttccttctaacaactttatatttttccttttaagttacaacccgcataacataaaatttcagccttctacagtgtgcagctcagtggctttagcatcagttagcagcagttagyaccatccaattccagagggttcccatcactccaaaacagagagaacacccttacccattagcagtcacttcctgttctcacagaaccagcccctccgcccatggcagccactcatctgctttctgtttctatggctttgcctattctggacattttatataaattggatcatataatatgtggccttttttatctgacatctttcactttgtatcatgtttcggagttcatccacgttgtaggtgtatcagttcttaattcctttttrtgactacatcacagctctgttgtatggataggccacattggtttatcatttcaccagtggatggacatttggattgtttctgcttattggctactgtgaataatgctgctgtcaacatatgtgtgcaagtctttagggaggatgtatgttcccagttctattgggtatctgtctgtaagtggaattgcaggtcatgtggcgattctgtgttgaactttttaaggatgtcaaagtgtttttcacagtggctgcaccatttgtgttccaccagcaagatatgagagttctagtttttcccatcctcaccaattttttttttttttttttttttgagccagagtttcgctcttattgcctagtctggagtgcaatggcgccatcttggctcactacaacctccgcctaccgggttcaagcaattatcctgcctcagcctcctgagtagctgagattacaggcatgcaccaccatgcccaggtgatttttgtatttttaggagagacggggtttcaccatattggtcaggctggtctcgaactcctgacctcaggtaatccaccctcccccggcctcccaaagtgctgggattacaggcatgagccactgcgcctggcctttccaattttttgttgttattttatttttctggtctcagaaactgcctcatatgtctaattttttaatactagtcatcatagtagttggaaagtggtatctcattgtgggtttgatttgcattgacctaacaactaatgatattgaacatccctcttttcatgtgtttattggttatttgtgtatcttctttcaagaactgtgtgttccttttttcttttttttttttatgatggagtctcactctgttgcccaggctggagtgcagtggcgcaatctctgctcactgcaatctctgcctcctgggttcaagcgattctcttgcctcagcctgctgagtagctgggattacagacatgtgcctccacgcctggctatttttttttttccatatttttttagtagaggcagggtttcaccatgttggccaggctggtctcaaactcctggcctcaggtgatccgcccacctcggcctcccaaagtgcttggattacaggcgtgtgccaccacgcccagcctcaaatcttttgctcatttttaaattgtgttatcttttactgagtttgtttgtttgttttgagatggagtcttgctctgtcgcccaggctggagtgcagtggcatgatctcagctcactgcaacttctgcctcctggattcaagtgattctactgcctcagtctcctgagtagctaggattacaggcatgcaccgccatgcctggctaatttttgtatttttagtagagatgggggtttcaccatgttggccaggctggtcttgaactcctgaccttgtgatccgcctacctgggtctcccaaagtgctgagattacaggtgtgagccaccgtgcccagcctgttgagttttatatatgagttctttatgtattctgggtactagacctttatcagacacatgatttacaagtattttcttccattctgtgcattgtcttttacttttttatgatgttctttgatgcacaaatatttttattttgatgaagtccagtttattaattttttcttcatttgcttctgcttttagttgcctaatccaaggtcacaaagatttacctctatgttttcttctagcagttttgtagttttagctcttacattaagtgcttcatccattttgagttgatttttgaatatggtatgagataggtgtccaaatgcattcttttacatgtgggtatcgaattgtaccagcaccatttattgaaaagactattctgtccacattaaattatttcaacacccttgtcaaaatcaattgattgtaaatataaaggtttgctactggactcttagttatatcccagtgatctgtgtatctatccttaaactacactgtcctgattacttagctttgtcgtaaattttgaaatcaggaagtatgaatcctctaactttttctttttcaagattttttcagctacatggagcccctcctacatccatgtgaattttgggataagtatgtcaatttctgcaaaaaaaaatactaactggaattttgaaaggaattgtgtcgaatcagtagataaatttggaaaatcttccagtctgtgaacatgggatgtcttcccatttatttagatcttctttactttccttcaccaatgttttgtagttttcagagtatatgttttatactgcttttgttaggtttatttctaagttctgtattccctttgatactattgtaaatggagctgttttcttcattttcagattgcccattgctagtatagatttttgtatattgatcttgtgtctggcaaccttgctaaacttgtttattgggtctaacaggtttttgtagattcttttgcattttctatagatgagatcatggcttctgacatggtctgccaatagagataattttacttcttcctttctatctgtatgtcttttattttactgtcttgcctgattgccctggctggaacttctagtaaaatgttgagtagaagtggcgagaatgggcctcctagtcttgtttctgatcttaaggggaaggcattcagtcttttaccattaaatatgatgtgagctttgtgttttcttaggctccctttattaggttgaacttcccttctactcctagaaggaattctaggagttctttctgttcctagtttgttcagtgtttgttatgatgaaagggtgttgggttttgtcaaatgctttttctatgcctattgagatggtcatctggtttttttcctttattaatatgatatattatactgatggagttttatatgttgaaacacagtttcattcctgggttaaatcccagttggtcatgatgtgaaatcctttgtatgtatatgttgctggatttggtttgctaaagttttgttgaggatttttgtgtctatattcatgagagatattggtctttggttttcttgccatgtgtttgtctggatttggtatcaaggtaatgctgctggcctcatagaatgcactgggaagtgttttcttcttttctactttttggaagagtttttgaaagawtggttttattttttacaccccatttgttagaattcgtcatcccatccatgaattcatgtagccatgtaggcctgaactttttttgtgggaagtttttttgactactggttcaatctctttattcattataggtctattcagaattttttttttttttttctgacatggagtctcgctctgtcacccaggctagaggatgttggcgcgatctcggcccactgcaacctccgtctcctgggttcttgcaattctcctgccttggcctccctagtagctgggactacaggcatgtaccaccacacgcagctaatttttctatttttagtagagacgaggtttcaccatgttggccaggcttgtcttgaactcctgacctcaaatgatccaccctccacagcctcccaaagtgctaggattacaggcatgagccactgcacccagcctattcagaattttctatttcttcttcttcttctttttttttttttttttgagatggagttttgctcttgttgcccagactggagggcaatggcacaatctcagctcactgaaacctccacctcccaggttcaagcaattctcctgcctcagcctcccaagtaactggggttacaggcgtgcaccaccatgcccggctaattttgtttcttgtgttttttttttttttttgagacggagtctcgctctgtcgcccaggctggagtgcagtggcacgatctcagctcactgcagcctccgcctcctgggttcaagcagttctcctgcctcagcctcacgagtagctgggattacaggcatgcaccgccacacccagctaatttttgtatttttagtagagatggggtttcactatgttgaataggatggttttgatctcctgacctcgtgatccacctgcctcggcctcccaaagtgctgggattacagacgtgagtcactgtgcccagcctaattttatatttttagtagagatagggtttcactatgttggccaggctggtctcgaactcctgacctcaagtgatcttcccacctcggcctcccaaagtgctgggattacaggtgtgagccactgcaccctgcctctctttcttcttgagtcaatctaagtagtttattctttctaggaatttgttcatttcatctattttatctaatttgttggcatccaattgttcacagtattcttctgtaatactttttatttctgtgaaattggtagtaatgtctcctctttctgattttataatttgaattggctgggcacagtggctcatgtctgtaatcccactttggaaggttgaggcaggaagaccacttgagcctaggagttcaagaccagcctgggcaacatagcaagacatcatctctaccaaaaaaaaaaaaattacctggacctgatagtgcacctgtagtcccagctactcagaagactcaggtaggagaattgcttgagcccaggagttcaaggctgtagtgagctatgattgccagttttattgccaattgccactatactccagcctgggcaacagagcacaacgctaataataataataataataatttgaatcttctctcattttttcttagtctagctaaaggtttgtcaattttgttgctcttttcaaaacacctccttttggttttcttgctttttctgtgttgtttttctatcctctatttcttctatttccactctgttacttcctccacacattcttgtgcacagtgctttgcttgatagtgatattcctctggtagctccaaggaatatttgtcacaattatcacgtacatgtggaagacctgtggtaacattggactgtaaagtttgtaggatcccagtgcagaggcaggctgctgagtgcaagagcgagatttgcaggatgtgttgtagaaagaacgtccttgagtgggttgagcgcccatgtgccttgcctcctccttttcccagcaagccagaggccaggatgctggagagtagggcaagcaggaagctgccgatctcagtcctcagtggggctggagccacccttgcctctgctgtgtgcacctctctgcagccatggggccacacaggtacctggcaaaagggttacatggagaacggtgtgcaaccacaatttcctgttcctgtctccatgtagactctagaataacctctaggaagcaaagctaaaatggggaagagagctttgcttaaagtgctctattgactgtggtgatcaacagctttgccaggaaaatggccaaaatagaacaaattcacatgaaaggacctcaaagctctgctctgaataaagtagtgattgctaaatgggatgttaagcatgaactatttcaagtagttctgctgaatagagccacattttctcattgagttagcttttagcatgctatggaagacattcagtttgccatggattctgtagatacaaaatgcttttcaagttggtttctgtgggaaagaaatcaggcttcacatgtacacaggcctttctactgcactttgccaagcactgccttatccttaacccttttattgccccaggaaatagaaaagtccgtagttccccctactttacgaggaaatctgttacccagaacagttgagcaatttgcccaggatcccaactctggtgtgtgccaagcccaggcagggacccaggcccccagctcccaggtgctgcccctgccgaggctcccctgggctgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagaggagaaaaccctagctcagaggttcagaaagttgcctgaggcctcatagcgggcaggcggcaggggtgggacatagacccaggtgtgtgacacccgcctctgcctctcctgtggctctgaggtccaaggcctgggccaggaccaactgcaggatggcagcaagcaccaggttgtggcgacatgtcataggcttagtggcctcacacgtcgtattttaggacaaagcctacacatgcgaatctttaaatcgcagagggtcctgcaaatgagcccaggagtgaggggagatgggggttcactctgaggactggaacgtcagaagagttggttgaatctgaggattggagaacaagcggggtttatgtattttgattatgttctacatctttccactttgttttatttgttcttcgacttgagcttcttcatctgcgtagaggatgtatttgcagtggaaaaggaaatggaggcaggggatagatgctcaagggcacatgaagtgaagccacagaaatcttttaaaattagcatcagcttctctatttagttctgttgtcctattctcttctctgggaagatacccctcctgtagtagttttgcggtaaagttttaacaaagtactcaaaacaaatgactcagttttcagatttgctaacacttgcaagggtttggagaaaatatttatagttgtgtttagcatcttcatagtctggagtttgctgtttgagttagagaattttctgtctgtgttagaggtacctctaacgcaagcatagttggtgtgaagtttcacattctgtgtgccccatgtgcttgagtagaagaggtgtctgttcttactgtgcttacagtggactctgaaatggtgtctatggtgtggttccagttttgtaaaacaaaactataaaatcccactaggctgggtgcagtggctcatgcctataatcccagcactttgggaggccaaagtgggaggatcacttgaacccaggagttcaaaatcagcctaggcagcgtagtgagaccccrtctctacaggtaattttttaaattagccaggtgtgttggcgtgcacctgtggtcccagctactccagctactcaggaggctgaggtgggaggatcacttgagcccaggaggtcaaggctgcagtgagccatgtttgtaccactgcactccagactgggcaacagagcaagaccctgtcttaatcaattaataaaaataaaaaataatttctcactgaaaacctagaagaaactacaacaaaggtgactgttatggggccgggcacggtggctcatgcctgtaatgccagcactttgggaggcccatgtgggcagatcacctgaggtcgggagttcaagaccagcctgaccaatatggagaaaccccgtctctactaaaaatacaaaattagctgggtgtggtggtgcatgcctgtaatcccagctactcaggaggctgaggcaggagaattgcttaaacccgggaggcggaggttgtgatgagccgagatcgcgccattgcactctagcctggacaacaagagcgaaactccatctcaaaaaaaagactattttgatccagggattataagtgattaaaatttaccatgttttcccataatgggtaggaaaactttttcatgatcagggagaaaaataggtatattttacaagggacccatcttttgtgggtcagtgagcaacctttcttctccgaggcacgtctctgacctacccagcccatataaatctgaaccccagtaggttgtccccccttccccctgccccacacaaagattttagagctagaaggagactggaaaacacataaccttgccacttccttctgcagatgaggaaagcaaggcctggcaaaagcaaggttcctggtctcagggtagtcagtggttgtgccgggcctcctcagcccctcatcctcaaggcccacaacagagcagcggcaagaacagtcccatccagggacactcacaggctaccgtagagacacacgcaaaccactggcgcctgtgcttccagagctgtgggcagagtgccatggagccagctggagagggaagtgctgtcagggccttggagtggtcagaggatctcacaagaggtggcactggtacaagaaaggcaagtaggagtgtagcaggcaggcaggacagagggtgttctaagcagaggggacatgaagtataggcactgagcagaaggcacccttgcccagggtgcagaaaggggctgtattgggagactggcacaggccggggcagggagggctgggctaaggcattggcatcattcttgaagagtttgaagccaggcaggtggcctggtcagaccatgtttgaggaaggagcctgtgtcacaattccctgtgaccagtcagagggtcttctgctggacagatcacatgcacccataagtaggtcagatgcccaggagtgttttgcctcagatatggagcaaaattagcctgacagtaaatgcagctctggtcctacctactggagcttaaagcaagactccgaagaatcaaactgtttcagagtaacttaccagcatcttagaacaaagctcaagaatatttacagattgcaaaaatatccaacatcagcaagataaaattcacatgggcaaccaattaacatttacccaacaagcagagaagcaggaaaatacgacctgcaatgaaaggggaagaaatccgtcaataggagctgacccagaaatgatacagatggtaaaattcatagacaggacattaaaacagttgttacacctttatgtgttcaagaagctagtagagagattcagcctgttaagtagaaaatgagagatagaaaaactccaggctaggccaggcatgcaacggctcacacctgtaatcccagcacattgggaggctgaggtgggcagaccacctgaggtcaggagttgcctggccaacatggcaaaacctcatctctactaaaaatacaaaaattagccaagcgtggtggcacacacctgtaatcgtagctactcaggaggctgaggcaggagaatcacttgaacctgggaggtggaggttgcagtgagcaaagattgcaccactgcactccagcctgggcaacagagcgagactctgtctcaaaaaaaaaaaaaaaaaaaaaaacaatatcaaaaaactccaggctgggtgtggtggctcgtgcctgcaatcccagaactttgggacgctgagctgggagaattgcttaagctcgggagttcaagatgagcctgggcaagatggcaagaccctgcctctaaaaaaaaaaaaaaacaacaaaacaaaaaacaacaactcaaatcaaatttgtagggattaaaattgcaatgtctgagctgaaaaatatcactggatgagattaatggcagcatagaaattgcagaagaaaagactagtgagcttgaagacacagcagtgaaaaaccatccacactgaagcccagagggaaaacaggctggaaaatgttcagagaatcagtgagcacagaccccttcaagtggcctcacgtaaatgaaatccaagtcttaagagggaagaagggtgacaggaaaaaaagatgtgaagaagaaatacaactgaaagttgtccaaatttgatgaaataattatgctgagtcaagaagccaaagaatacatactgttatcatttcatttatataaaatttggccaggtacagtggctcatgcctgtaatcccaacactttgggaggctgaggcgagcagattgcctgagcccaggagttcaagaccagcctaagcaacatggcaaaaccccgtctgtacaaaaaatacaaaaattagctgggtgcctgtagtcccagctgctcaagaagctgaggtgggaggatcccttgagcccaggaggcagaggctgcagtgagccatgatggctgccacctcactccagcctgggtgatagagcatgaccctgtctcaaaaacaaacttatttatataaaatactagaaaatgctaacacaggccaggtgctgtggctcatgcctgtaatcccagcactttgggaggccagggcgggtggatgacctgaggtcagtagttcaagaccagcctggccaacgtggtgaaaccccgtctctattaaaactacaaaagtcagctgagtgtggtggtgcacacctgtaatcccagctacttgggaagctgaagcaggagaattgcttgaacctgagaggcagaggttgtggtgaaccgtgatgacgccattgcactccagcctgggcaacagagcgagactccgtctcaaaaaaaaaaaaaaggaaagaaaatgctaacacagatcagtgcttactcaaggcctggcagaaatttcaaaggggaggtgtggcagtggcttcaagagtgtatgcatatgtcaaagcttacccaattatgtactttaaatgtgtgcatttcattgtatgtcagcatacccctgtagagctggtttttttttttttttttgagacagaatcttgctctgtagcccagactggggtacagtggtgcgatctcggctcactgcaagctccgcctcctgggttcataccattctcctgcctcagcctcccaagtagctgggactacaggcgcccgccaccatgcccggcaaattttttttttttttttgtattttatgttgatacagggttttaccacgttagccaggacatacaaaaaattagccaggcgtggtggcgggcgcctgtagtcccagctactcaggaggccgaggcaggagaatggtgtgaacccaggaggcggaacttgcagtgagccgagatcgcaccactgcactccagcctgggtgacagagcgagactccgtctcaaaaaaaaaaaaaaaaaaaaaaagagttagccaggacggtctagatctcctggcctcgtgatctgcccacctcccaaagtgctgggattacaggcgtgagccaccgcacccggcctgtttttgttttttagagacagagtctcactccattgcccatgctggagtgcagtggagtgattgtggctcactgtaacctcaaactcctgggtcaagccatcctcccacctcagcctcccaactagctaggacactacaggcatgcaccaccgcacctagctaatttttaaaaaaatttgtagaggcatagtcttgctatgttgcccaggctggtcttggactcctggcctcaagcaagcctcccaccttagcctcccaaagtactgggattacagatgtgagccaccatgtctggcctctgtagagttgttttaaatattaaagtgtacaaaaaaaaaatttaaatgggccgggtgtggtggctcatgcctataatcccagcactttgggaggtcgaggsgggtagattgcttgagctcaggagttcaagaccagcctgggtattattgtgaaatcccatctctatgaaaaatacaaaagttagccaggtgtggtggcatgtgcctgtagttccagctactggggaggttgaggctgcagtgagctgtgatcatgtcagtgcgctccagcctgggtgacagaatgagaccctgtctcaaaaaaaaaaaaaagttttaaatgaagattatagggtaccctacattgtgtttggtttgcagagggaacagaaatgagtgaagctgcctaagcatggtggctcacacctgtaatcccagcactatgggaggccgaggcaggtggatcacctgagctcaggagttcaggaccagcctgagaaacatggtaaaaccccatctctaccaaaaatacaaaaaattagctgggcatggtggcacatgcctgtaatttcagctactcgggaggctgagatgggaggattgcttgagcccaggaggcggaggttgcagtgggctgagatcatgccactgcactccagcctgggcgaaagagtaaggccctgtctcaaaaaaaaaaaaaaaaggaaaaaaaaaaggaaatgattgaagctgtttttggagttaactgaccaaaagttaaatgactaaaagaagagcgaggcaggaggttatagaagcaatcatgaaaaaaatacagatccccagggtcccaaacctggtttccgaggatgggtagtgtttgaacttggacttgagactcaatgggcattttcagtgaccagcaggtaaagaggcttggcctagtgtttctgagtagggaagagtgctcctccctgctgccttgggaggactgtctgctgctggaccaccctgaggactgtgagacattagctctgtgggcttctaggctcctggcagtgaacctctgggagtgaaggatgcacaaaggatgttgtgggaaagagaagatctgagatgtcctttgggtcatctttggaggatcttgactctgaggctggagggtttgtggctaattccatgggcagtgggggctgttggaggctcttgagcagggccggacaggacccaaatggagaaggtctgcagtgagctgtggaaattctttggcctgattcgctggatttgtggtgcacatctgtgagatgtgagattgggatggagtggacatggggactctgacatggattgttttggggcagaagaagccaatccatgctggcgtcccagcctgggtctgtaatctcattaatctccttttggtgactggaccagttgcctgtacaagtgcctcttggtctccttgatccaacctcactgagccagcgtcgcttgtatgcatgatactgcaagacttccttcccagctggcctgcacgcaggtgccttggagaggcattgggcagatggcatgtggccatttccagcagtggggcgcagtgctcagggagactgcagcatcctggagccctgccagccaggagggactgttcccattgcgggcagaatctgttacttgcaatcagaagaacttcarctaatacttgttttttgcctgtagattcaattgaccttgggaatgttgcttaaactcgcctttcactttcattttcctatcagtaaagtgaagggtcatatccacattagagccatcagaggagcttattaaaaatgtccaggcctcggccctccctggagatatgaattcagcaggtctggggtgaggcccaggcatcttggttggtttttttttttttattttttattgatttatttgagacggagtcttgctctgtcgcccaggctggagtgcagtggcatgatctcggctcactgcaagctccacctcccgggttcacgccattctcctgcctcagcctcccgagtagctgggactacaggcgcccaccaccacacctggctaatgttttgtgtttttagtagagatgggttttcactgtgttagccaggatggtctcgatctcctgaccttgtgatccgcctgccttggcctcccaaagtgctgggattacaggcgtgagccaccatgcccggcctattttttatttttgagacagagtctcagtctgtcattcaagctgaagtgcagtggtgcgatcatagctcactataaccacaaacccctgggctcaaacaatactcctgcctcagcctccaaaatggctaggggtatgcaccatcacacctggctcattttttaatttttattttgtagagatgaggtcttgctgtgttgtccaggctggtgtcaaactactggtctcaagtgatcctcccacccctcagcctcccaaagtgctgggattgcgggcgtgtgccactgtgcctggccagttttgttttttggttttgggttttttttttttttttttttttttgagatggagtcttgctctgtcgcccactggagttcagtggggtgatcttggctcactgcaacctccgcctcttgggttcaagtgattctcctgcctcagcctcctgagtagctgggagtacaggcacccgccaccacgcctggctaattttttttttttttttttgagacagggtctcactctgtcacccaggcgcgtagtgcagtggcacaatctcagctcactacaacctctgcctcctgggttcaagtggtcctcccacctcagcctcttgagtagctggggctacaggtgagtgccactatgtatttgtatttttagtagagacggggtttctccatgttggccaggctggtctcaaactcctgatctcaggtgatctgcccgcctcggcctcccaaagtgctgggattgcatgcgtgagccactgtgcccagccacacccagctaatttttgtatttttagtagagatggggtttcactgtgttggccaggctggtctggaactcctgacctcaagtgatccacctgtcttggcctcccaaagtgttgggattacagataggagccaccacaccgagcctggtttttatttttcatgaaagtcatacatgaaatgccaagtgtggtggtatgtgcctctagtcccacctactcaggaggctgggtgggaggatcactggagaccaggatcatccaccgcactccagcctgggcaacagagtgagcctccatctgtaaaagaaagaaaacagagtcacatgtgaaaatcagtaggttgacatgtcagtgggttctataagatgtgctataagaaacatgtctctcctgccaattttgccctctctggagagttcctttcagttcttttcgctgcctgtctctgaatgctgcttcgggagctgtgtttggtcccctgacttcaggtgtttctggttgactctctgcgggaagagaagcatgcagagctcttgcatcccccgtcccccattcccccagccacccacctcccttcctacttccaccctgccagagctgcagtgcttcctgggcacgggccttgctgtgaggacagaggagctcttcacagcggaggcaggggatgaatcacacctgcagttccttgtctgtgtgactctttgttttccctggacttgataatcatcttgtttgctcatctagttttttttctttttttttttgagacagagccttgctctgttgcccaggctggcgtgcaatggtgcgatcaatctctgctcactgcaacctccaactcctgggtccaagtgattcttctgcctcagcctcccgagtagctgggcttaacaggcgtgtgccaccacacccagctaattttttgtatttttaatagagacagggtttcaccacattggccagcctggtctcaaactcctgacctcaggtgagccacctgccttggcctcccaaagtgctgggattacaggcatgagccactacacccagcctgctcatctagttttctaagtgcagttccacacattcaatcccaaactctctgccagttgtctcacacattaggaatgtgtcctctccatttcttccccctgcagagatctctcctgcaccctcttggccagctccagtctggcctcgttcctctctctacccgggacccagctgttgtcctagcgtcacctttgacctcccctcatgttagagcccctttctcccggatcccgggtcttcctctctctgtgtctgtgtttgtttgggtggagtttatcttccagtcggttcccaaggaagggttcatggttggtgactttttggaggtattgcatgtctgaaaagtctttcatctgtgttcacccttgaccttgctggatatagcagtctaggttggaaaccattttcctttaggattttgagggtctttctccattgtctctcggcttccaggattgctactgagaagccagaagcctttcttttttttttttttttttttttttgagacggagtctygctctgtcgcccaggctggagtgcagtggcatgatctcggctcactgcaagctctgcctcccaggttcacgccattctcctgcctcagcctcccgagtagctgggactacaggcgcccgccaccacgccyggctaattttttttttttttgtatttttagtagagatggggtttcaccgtgttagccaggatggtctcgatctcctgaccttatgatctgcccgtctcggcctctcaaagtgctggaattacaggcgtgagccacctcgcccggcccagaagccgttctaacacctgatccttgatacttgacctgtttttctttctgaaagtttgtaaggtctctttgttcctagtgttataagaacagatacatagtggtatgccttggtgagggctgtgttcatccttgcagccaggtggttgcagcctatgtgctggtgggtgtctgggtcctctgctggggtcctcttctgccccgcctctcttgttttcctttttttgttgttatgtttttgtgtgttgttgttgttgttgtagggtttttgttgttgtggggttttgttttgttttgttttgtttttgagacagggtctctcactctgtcacccaggctggagcacaatggcgcaatcacagctcattgtagctttaaacttgtgggctcaagcaatcctcccaccacagcctcccaagtagctgggaccacaggcatatgcaccatgttcagctaatttttttattattttttgtagagatggagtctcactatattgcccaggctgcttttgaactcctgggctccagcaatcctgccaccttggcctcccaaagtgctggattccaggcatgagcaactgcacctggcacccctcctgttttctgtytgctctggctgaaggcctccttttccttttcttttttttttttttttttgagttggtgtttttgcccttgttgcccaggctggagtgcagtggcgcaatctgggctcactacagcctccgccccccgggttcaagcgattctcctgcctcagcctcccacgtagctgggattacaggcacccrccaccacgcccggctaattttgtatttttggtagaaatggggtttcaccatgttggycaggctggtttcgaactcctgacctcaggtgatccacctgccttggcctcccaaagtgctgggattacaggcattagccactgtgcccagcctggaggcttccttttgtattgtggactttctaagctggcctccacttttcctttctctcctgtttctgtctttttatgcttttatcctgctttctagaagacattctcaaccttatttctccaaccctctgtcagattatttccatgatcacatgtttaatttctgaaagttcctgttgttgtttgatggctgtagagtcagtcttctctcatctccctaaggatgttttggaagtttcttctccctgcctggtctttgtatgtcccaagttgtgtgttttctgtctagttcgccttttacatggcagaggctttcttcagatgttggcagtcccctggttggaagagtgaggcccagcaaggctgactggaagccctgagcacatgcatggagcctgtgggccccgcrggtctctgacagcaatctggctgggctgctgggtggggagtcgttgcttttagccttccagggcccgctgagtccttgccatgcatcccccactttccagcttccagaattgtatggctgcttcctcccctcattctctctgtccttaggagatttgaaccttttttctttgagatggagtcttgctttgtcacccaggctggagtgcagtggcccgatctcagctcactgcagcctccccctcctgtgttcaagcaattctctgcctcagcctcccgagtagctgggattacaggcgcatgccaccatgcctggctaatttttgtatttttggtagagacagggtttcgccatgttagtcaggctggtctcgaactcctggcctcaggtgatccggtctgcctcggcttcccaaagtgctgggattacaggcgcgagccactgcgcccgccccgtttttctttgtttaacccattccctctcatggtagtggtgcttgagaagggagtgaaagagtaattgtgtgctcattatcatcactgcccagaagcttctggcttcttcagcgccctgcaggtgactcttgcacatacccagcgctgagcaccatggtgcagctcatccccttcacctccacggttctggtatcacagtcttcagagtatagccactattttcctctaagcctctgaacatctttgagtggtatttaggtgctggtggggctgcctgttacactgtaagttgttccgtcagcacaactatgctgcctgcaaatgaaggtatgaaacctccccaaactgctgtctaatggtgtgggatggaaccagctccctttgagagaaactaaattgttttttgccacttcctttaattttttccatgttgcctttttttcctatacctccatttaaacatctattgtttttgagctctcttcttcaaaacttgcttctaggaactattacccctcttcaccatattgaactctaagtcttttctctcattctggaaggccatgatacctagaagtagaccacagggttctaacggggtgccctgggtcctgcagcagtcccctcatcgtgctttaacaacttatgacccagtagtttaaacaacgacctagggaagcttgtcccagcctgccctgcgtgtgcccccagtaaaaccatgagcggcaggaaggggagcccctcgcgatgcttgccatgaccctagaggagcagagcccagagatcatctttagggacctctccctctgggctgcactcatccagaaggtgcttccccgagcctgtctgtagagtcagccacagagcagggcgatgagctatcagagaccagggtrtgtgccactgggtccagcttctgctcttcttgtctcacagcaatatttgagtcctggtgctagccatggcgcagtcgttgggctggtatcagtgacaaggtctggagggtagacaggaagagtggccagttggctccaccagcccctgctcaggaaggacagaatgtgacaggcacccaggaaacctgcttctgagcgttttctttagcgcaccccctacaattagcagatgcagcttcttgctggattctgaggtcacacctcagaccagatgtagaggcccagcagtaactggagtcagtgcagaaggacccaccacggagagggagaggcctctgacaggccagaagagagcagcagtggagcctgtttctgtctggagccctgctctgctgggccagaagtttccaaatgttttttagcagtgggacccattcttcaaattaaaaaaaaatttttttgagttaggctcttgttccgtcacccacgctggagtgcagtgacacaatctcagttcactgtaacctcaacctcctgggctcaagtgatcctcttacctcatcctcctgagtacctgggactacaggtgtgtgtacaaaatacaaaaaacactcccagctgtccagccttaaatamaatcttgtacataagccagatgtgttcaacaagtaacagcaaaactggtcccatgaaactgccccttccacaggggccctgaggcacctctgcaaggccagggccccacaggcrctgctggaaaactgctggtcttcgggccagtgaggacagagagagagctcagcacagcaggccccgggcagccatacccacctcgtaccacggtcagagtctcgaggagcctcagagatcatggtccccggctcctccagctaaggacacagaccacgaagaggaggtcctcctagtgtgtcagccctggctctgagaatttacctttaatttaattctagacctattaacatgggtatcgggtttttaagcccatctgaaattgggaagaatagaccagaagcaggaagagggtctgctacagggaaaaaagaactagaaagaccaaacagaagtcagaaagtacagctaccacggggccatgtgacaaatggcccaaccaacccacacgcctcagcgccccctgaggctgcacggatagacggacagacacacagcagcaccatgaatccttgagggaaagtaaagctcagcatgtgtcagtctttacggggattcaaggttaaaacagggagggagagagacttggagggaaaagaaaaggcagtgtggaaagcacaaatggccgcctggataaccgtggtttgtttgggttaggattatttccagaggcgtctttcctggggcatttgtgctgccgcttcaaaaaccctcggtccaccctggtattcctgaaacattcctgctgaatttcttccaagttctgataagtccatgccaaaatggtctgtctagatacatgtttcctttggctgtgaaatcttcagcatgtttttgtttttcagcctgggtttaccacattctgactgaggaacatgtgtgagtgtgtgtgtgcgtgcgcacacgtgtgttgataaaagctatgataaaagctcagctacaagaagtttgaagaactgtggtctgagccccagacacttgtgttttctttttcttttcttttctttttttttgagatggagtctcgctctctcccccaagctggagtgcagtggcgcaatctgggctcactgcaagctccgcctcccaggttcacaccattctcctgcctcagactcccgagtagctgggactacaggcgcccgccaccacgcctggctaattttttgtatttttagtagagacggggtttcactgtgttagccaggatggtctcaatctcctgacctcgtgatccgcccacctcggcctcccaaactgctgggattacaggcgtgagccaccacgcccggcctgtttgtttttttttttttgatacggagtttcactcttgttgccgaggctggagtgcaatggcgcgatctcggctcaccacaacctctgcctcccgggttcaagcgattctcctgcctcagcctcctgagtagctgggattacaggcatgagccaccacacctggctaattttgtatattttttagtagagatggggtttctccatattggtcaggcttgtcttgaactccggacctcaggtgatacgcctgcctcagcctcccaaagggctgggattacaggcgtgagccaccacgcccagcctcttttgcatttttatgaagtttttaatatgaataagccaaaattttagatcacctactactttttttttgtttttttagtagagattaggtctcgagctactgggctcaggcaattctcctgcctcagtgtctcatagarctgggattataggtgtaagccactgtgctcggcctttttttttttttaattgaatttttttttatttttttgatacgtagtttcactctttttgcccaggctggagtgcaatggcgcaatcttgactcaccgcaacctctgcctcctgggttcaagcaattcttctgcctcagcctcctgagtaggtgggattacaggcgccccccaccacgtccggctaattttgtactttttttttagtagagacgaggtctctccatattggtcaggctggtctcaaactcccgacctcaggtggtccgcctgcctcagcctcccgaagtgctgggattacaggcatgagccactgcacccggcctaattgaaatttttattgagataatggtcactgcacttgtatttataagaaatcctgagtaccctttacccagttcacagcaatggtaactgcaaaactatagtacactgtcacaaccaaggcttgtctacttttttttttttctaaattgtgataaaatacacatgagatttaccgttagtgacagtacatttgcaatgttgtgcaaccattgtcactatatagttccagaacattcttttttttttcttttttgagatggagttttgctcttgttgtccaggctggaatgcagtggcacaatctgggctcactgcaacctctgcctccccaggttcaagtgattctcctgcctcagcctcccgagacactaggactacaggcatgcgccaccatgcctggctaattttgtatttttagtacagatggagtttcaccatgttggccaggctggtctcaaactcctaacctcaagtgatctgcccacctcggcctcccaaagtgctgggattacaggcatgagccactgtgcccaacctagttccagaacattcttatccctcaagaaagcccctagcaatgtgaagccactccccattcctcctccctcctctctcccagcctgtagcagctgctcacctgatttctacctgggattttcctcttctggatgtttcatagaaatggaatcctggctgggcgcggtggctcacacctgtaatcccagtactttgggaggctgaggtgggtgggtcacaaggtcaggagttcaaaaccagcctggccaaaatggtgaaaccctgtctctatcccagtactttgggaggctaaggtgggtggatcacaaggtcaggagttcaagaccagcctggccaagatggtgaaaccttgtctctactaaaaatacaaaaattagctgggcatggtggcaggcccctgtagtcccagctactcgggaggctgaggcaggagaatcacttgaacatgagaggcagaggttgcagtgagccaacatcacaccattgcactccagcccgggcgacaagagcaaaactgtgtcaaaaaaaaaaaaaaaaaggaatcctacagtgtgtggccctgagtgatacgtgctctctctgacagcccctgagtgtgtctgggttttgtctgtttaaatgagggtttattcagccccagacttctggtacaaaccaggggacagctagccgctcttgcactcagcacagctaacaaaccagcagtgccaggctcagccgggagttcttttgcctccaaagaaaggcttgagaagaatctacactaactttagtggaggcacttacatcagtgcctccactaaaaataaagcaaaaacaagcaaatccaggtgacagttacaaaaaaaaaatacagtgagtttataaaataaatacagcaaaggtgtgttgagaccgccagtgaatcaggtcactgtgatgaaagccgcacagcaggtctgtgtgttaaccccacgcggcaccttccttgctcactgtgagcaaacagtggaattccctgctcccaagatcctgtgctgcttcccactggcaccactctcagaccgtaagaaatcggtttgctccagaggaagatgatgaagtcatttgctttgaggtccagtgattatcattgtttctgacctaatagaaaatcatccctcactgatgcccagccctgctggtctcgaagcccctcacaggcatcatgtcatgacacccagggtgtgcccagagccccagcaggcaggactgccaggcagggctaggaccaggcctctctgttactaacctagagagcagtcagcaaagcaacccccgagtttgccaacttttcaagcgttggttttttgtctgttgaaacctcggtgtattttagcagaggcgccttcccgagtcacccgacatctgtggctcggggtcatgattgccgcgaccacccggggtgctgagctccgccccggcctggcgtctgctctgaaaaggtccagactcaggcagagcagacaccccagggccactttgccagtccttcagcaggcgccatgggctcctcctccaaacctgttccatcggcctcttagggcctgcctgtaccaccagcccctggcttattgcaccagcgtccggaacggggttcttgttctacctgcccttccctgcagcttgtcctcactgcagccagaagggtcctcagacgacatgtgctagttcatatctctcctctttttttgtttttttgggttttttttgagacagagtctcactcttattgcccaggctggagtgcaatgtcacgatctcagctctctgcaacctctgcctcccgggttcaagtgattctcctgtctcagcctcccaagttggtggaattacaggcgcatgccaccatgcccgattaattttgtacttctagtagagatggggtttcatcatattggtcaggctggtctcaaactcctgacctcagatgatccacccgcctgggcctcccaaagtgctgggattacaggtgtgagccaccgcgctcagcccacatctctcctctttttttacttttattttgtttattattacagagggtcttgctctgttgcccaagctagagtgcaatggcacgaatatggcttactgcagcctcaaactcctgggctcaagttatcctcctgcctgagattcctaagtagctgggactataggcacatgccaccatgcccagataattttttaaattttggtagagacaaggtcttgctgttgcccaggctcgtctcaaactccttggctcaagcagtcctccctccttggtcttccaaagtgctggcattacaggtatgagacaccgtgcccagccctttcctcttttcacacccttctggcagcttcccacgtcactcagaatgaaatcatacttcttccctcagcctgaagcctgccatcagccctagcagccactctggcctcaccactgggctgcagcctcccagcctccttgctgcaaccctgagctaccctcagttctacacttgctggggctgctgggtaccttccctaggtgttggcaggatcactgcccctccactccaggcagagtcagggtgtccctctggcccttctctctgttacgcagtatggcattggtttgtccgggttgtgccccaccctccccagtaggatggcagttctgggtgggcagaaacaagtgttttgtttgcagttgaggtttccccaaaacccagcatgtgtgggtgctcatttgtcgaacaaatgatcacatgcctccaattagaggtgtccaggagacagctggtgtgaggccttgggccacatgagccctgccagtggtaggggtggtatggtgtaccatggaacccagtctgggaaatactgggtaaaggcatgaggcaagatgataaacctggaaagatgtgtccagaatgacttgctcttcctcttttaaagagcatttactggtgtccccatgtgcttttcgtcagactgtgctctcccaccctctgagacctggcctccatccctaccccttcctgaagccctcctgggctgtctgcaggctggcctctcacctagagtgagggccctgccagggagtgccagtcctcctttcggagagaagccactatgccatgagcttccgtcgtgtaaagtcagacccagacagcccaggccctggtgtcaggagtgtggcagcagccagggccggggctctccttctccttcttgggccagccactggtcacacaggtgcactcaaattgggaagctctgtcatgctgtgcacttaggatttgtgtagttttcaaatgtatattttcctccagtaatacaaaatagagtttctttttattggataaaagcgggtgaggggctggggacgcagaatgtttctgagggaagcaggtggtcagggtccatcctccacgcacctcctcagcatcgggctgggctggagctgggcagacgtggcctcctcctgcagggagctcccaggcagcacaggggcccttcccagaggcctggcaggcagcgtgagtggggttgtgaagggtgggcagcagcgtgccaggtgagcaacgcgtgagggggcgtgtgtgtccggaagggacgactggcaaggccagggtgaggctgggccccgcttgctcttcccaccatgttctgttctagcggcttctagtaaaggctgttaatgggcggaggctcacattaggaggcagagcccggaagcgagagagccaagggagacagggaagttttatgttccagagacgttgcgaggtgatggagagaagaggaaagggatgcggggtagccatcctctgcccgctcacgagcacttctccgcctgccaccgtgctgcttccagcgcccatctttctctatctggagacccctcagagactccactttggtccttgctgttcttgcccttctgctgaagcacagtcatctcctcctctctccatcattcccgttgtccttgacttactattcaaaagctagctgcttcaaaccacagcgcgtctcagctctgggccaggactacgggcagtgtgtgggggagtcctggctctgctccaccacgtcggggccctggccagtgggctgaatggcgaggcctgggccgcttttctgtcttctccacgcggccttccgagtggggaaggcgggagcctggcgggagcctctcctccacatagcctggtggcctcagcctcggcctcagctggcaggcctctcccctcccttccctggagcccctgcatcccctggaatgggggcttagcctagaacagcgcttccccaaatctgcacctctgaaccccaggtccatggaatggaaatggatgtgatgtatggaaagggggttccatagccaaacaagttaagctaagttcagagggaaggtggtgaatagaaatcccaaacatctgatcccagcacagcyagcggtggggacttgccttgagtgcgctccaggtggtccctggggactcggtcctggcacccctgccctcctggattgcatcccacagccctgctggccgccccgccccagcctccctgctgtgacaggggcaggggctgcggtgaccctgcagcacaggcgcggctccctcggatcccttggatctcaccggtgcatctgrggttctgcgtggaaagtggctcgggcttccaatgccgctctgctttaagctgggaccgctgtccagggtggtgcccagccttctggcatctgccatccaacccttccctctctcccctcagtggccctgtgtcctccgggcatcaaccctaatgccacctcctcacctgaccacccactgccagttgctcattttatttcctggtggtgcctcccatatctgaacctagcctggtgcttacgtccaattgcctgctctggtgctacctgagagccccatccagcccactcacgaaggcttccagagcctgtgcctgtaacttgggcaaatgtgtggagtgagcgaccaaagggctgagggagcagcgaagggagcccctcgctaggactctaggactctgttctctctgtgtctcttaaaatagctcactcgtggctgggcgcagtggctcacacctgtaatcccagcaccttgggaagccgaggcaggcagatcgctggaggtcaggagttctagatcagcctggccaacatggtgaaaccccgtctctactaaaaatacaaaaattagctgggcttggaggtgggcacccataatcccagctacttgggaggctgaggcaggagaatcccttgaaaccggaaggcagaggttgcagtgagccaagatcacgccactgcactccagacacagtgagactcaaaaaaaaactagctcggacgggtgcggtggctcacgcctgtaatcccagcacttttgggaggccgaggtgggcggatcacctgaggtcaggagttcgagagcagcctcaacatggagaaaccccgtctctactaaaaatacaaaattagcctggcatggtggtgcatgcctgtaatctcagctactcgggaggctgaggcaggagaattgcttgaacctgggaggcggaggttgcggtgagccaagatcacaccattgcactccagcctgggtaacaagagcgaaactccgtctcaaaaaaaaaaaaaaaaaactaaactagctcattcacctcactggcaggctgagacctgcagtcactccagcggcaccctgagtgagctcacacaagagagaactttggccaggcacggtggctcacgcctgtaatctcagcactttgggaggccaaggggaatggctcacttgaacccaggagttcaagaccagcctgggcaacatggtgaaacccagtgtctacaacaaaatacaaaaattagcctggtgtggtggtgtgcacctgtagtcccagattcttgggaagctgaggtgggaggatcacttgagccagggagatggaggttgcagtgagccgggattgcgccagggcactccagcctgggtgacagagcgagaccctgtcttaaaaaaaatttttttaaagagaactttctgacagccagaatcaggtgggggcaggagggagggggtggccctgtgcctgtcagtgttttggctgcggagctgcgaccaagtctggatgtgtttgggatttctattcaccaccttccctctgagcttagcttaacttgtttggctatggaaccccctttctatacatcacacctatttctattccatggacctgggattcagaggcgcagatttggggaagcgctgttctaggctaagcccccattccagggggatgcagggactccagggaagggaggggagaggcctgtgatcactctgcaaagcagggctgggtggggaggccgggcggctggggaagaaacctgccatgtctgggaagaccggttggtccttagaggacctagcagcagcaaaggcaaacactggctcaggcagtggtgactggtggtgatgtgccgacaagagcggccaccgccccgtcctccttgctgctctgtctctccatcctccatgtcctgatccactgggactggccctggggctgaggtgtgagacttggtgcccacgggaggcatttcatacatgcgttcatcagcccacagttaggggcccctgcccagagcagccggcgggtgaggatgcgggcagcctggagagggcacctcgatccgggaggtgcaggtggagggaggtcccactgcctgagggccctgagagtgtctggccccggcaagtgtgtgacacgggcactatgacaggagcactgtgcggccagagtgtggcacagggcatccagtgtgattgtattcacggcagccctgagcacaaagcaaggagcaggagatgtgtggcggcagcgagggatctgccagtttccactgggtggcccactcggtcccatggaggccgaccaggagggcagggacccaagaccacagatgtagcagggaagactgtgggttccagaaaagcaggcagtgccaggcagtgggggacagccagcccctcggggctcgggtcacccaccagcactgctggtgaccagaggcccagatcctccagacagtgctgtgctcgcgggcatggaggcctggtccaactgaggggtgggaagccctggggcaaactggagttgccggtggacagcaaacaggacactggagggacttcctcctgtcctgtgaagagcagacaaaggaccggagatgctgagcatggacagaggctgcccaaggaccagggcagggcggcagtcttgtgccgcggcctggtcaacgcagatgttgcctgcscggcagcacattcgggaggacagctgtgcctagaggagaggggcctcagctgagccaggatggtgagggcagcacaggcaggtggcaggggctcctgggctggcgtttttgtttctcacagtgcccaccatggtccttcacagccaggtccgccgcatctctcctctcattcctccactctctgttcacctgggccatccctgcccttcttggcctcctgctggagtccatgctggtatctgctgggctgtccctcagtctggcccacctgacatyctggagacaagtgaccatctcccccgtgagactggcactaggggcaggacgtggcctctctgcctcctgcggggcccacactggctgctgcatgctgccactaacatgtccccagttccggaagtctcctgtcckttctcttgtcacccaactcctgccttccctgaaagtcccttcccgcttccagcccgccggggtcagcttggtcagcgtccattccagccccaacgaccagatgctgtgggtgcttgacagcaggtggaacgtgcacgtgcggaccgggatcaccgaggagatgcctgtggggaccgcctgggagcatgtgccaggtaggagcctgcagacagggcctgtggtgccggccagccggggctaccatcactgggggctgctgggcgctccctccaggccgctgtctgtgaggcagcctttgtgctggggctgtgctgtcgccgctgcttcctgggccaggggacaagcctcccatcatgttccttatcaggggaacccargccgtcctgctggtgcttttgtgggagggcagtttgcacactgcccaggcccttctgtcctttgacttctggctttcggtggctttgctggccctgccaactggtcgtcctttccctcggctcctgccccaagcccagcccatcatgggcactccgtccccgcagggaccctggtggaggtgtgcagcgtcacaagagtcggcttgggaagcagcggcccatcccgtccatggcaggggctcaggagggaccctgtctgcccacagggttgcaggcctgccagctggcgctgagcaccaggaccgtgtgggcccgctgtccaaacggagacctcgcccggcggtacggcgtcacagacaagaaccccgccggggactactggaagaaaattcccggcagcgtgtcgtgtttcacaggcaggtgcccggggccagtgggcttaaggccccttggggttcccagggctcctgtggacgatgtcggggkgctctcraagaagccgaccccactgggctccaatctctcaaagcaagaactgagggcaaagccaggagtgtgtcccagggagggaaggggctggacacctgggctctgccagagtctcctgggcaaggacaaggtgctgttgacatccacttacagctgagggtacgaagttcacatggagatggtggcttgtccagtgtcccccacctagaatgtggcaagcccagacctgcgcccaagctcccagctccatctgtgcccaagctcccagctccatctgtgcccaccccacaggctgtgtgattgacaagtatgtgattgrctcttgtccctgcagtgactgcgtcagatgagctgtgggctgtgggcccgcccggctacctcctccaacggctgacaaagacgttcagccactcgcacggcacccagaagagcagccaggccgccatgccccaccctgaggacctggaggacgagtgggaggtcatctgaaggagccctggccgagtcacgcggaggggcccggcgtctgtggcgggcacaggggcttcrgagtgactccctggtggacgcrctgcctcaacacttgtccagacacctctggccaggttggacccgcacacttactttcatctatgttggtttctgtctcgttccagaacccacagcctccacccrtggctggcgtgattgctgcagcagtggcgcctcctagctcaggacagtggcgactgcccggctgcatgcactccgattacccacgtgctgccgtcctggtctcatccacagatagctccagcttttgttggtgggagtggtctccggaggcctcccagaaccaagggtagccgggcagctggtttggcccagggcctccttccacattagtagccccagggccagatggagccaaaggtcagctctctgcagcgcgggatgtgctcggtgatggctttgtcccatcataggggggtgtccccccagagacaaagctgcagagcacattccatgccagacgctctggccaggaagctgaggccgggcttgagaggagagcgctggccatgccaggagagaacccacgcacatgcacaccacaacacacaacacacctcacctcacaccacagcacacctcaccacaccacaccgcactgcaccatacctcaccacatctcaccacaccacagcacacctcaccacacaacacaccacaccccacaccgcactgcaccgcaccgcaccgcaccgtacctcgccacatctcaccacaccacaccacaccacacctcactgcccacacacggcgcaggctgcccgcctcctggagagcrcwcttcagctgaaacagtaaagcctgatgggtgcaaatggaacctggatgtgtgcacgtgtgtcccaggtagggacggcacaggagggtgcatggggcgtgggggagctgagcaagggtcgctcacttagaaatgtctttggaatggtgtttaactaatgctgctggcggacatcctaaaaccagatgcatcctcagaggacgagtctactaattattgcctttgttgttgtattacaaatctgcataaaatacctcatttcaaatcaaatcttacaaatttagaagagagatatgttttccgaaaacagtggaagccctttgttccttcccgggtttgtcctgagcytgcactgtcctygcctgcagcctcagaggggcaggcatccccgcacagacttgactggcagggcggtcacgggacctgcgggctggctccgagtggcagcccatgccttctgcrgggtatgggttgacacttgacaggttgaaaccagtgcctctatggacggctgctgtggccccttcagacaatgggcagtgcccaccccgcccactggcrtctgcgtgtgagggctaggccgccctgccacacatcccgccccctcccggaggcagcttcaggacaggacaccaggctggctgctttttttagcctgcccctggcccaggcccagtccttggtgtcagggagcccccaggccgcaggtggagggtgataaaatatgttctctgacaggacccagccagccacataggtggaggttttccatgtccaaatgaggtcaagatgccgaaatcccagatctgacttcacacttcccttttctagaaccttttgtaaaagttggtggcagcagaggcagccccaggccgggctgcatctctctgtgtctgttgtgccttgcccggcgcctcacggatggcaaagctctcctcacccatgggactgtagtgcaattaaacccgcgtctaggtgatgcttttaaagttgtagcttcgtgctttgtacagttttctttctggttttaatttttagttgtgctttgagtcagtgcaataaactagactttttccaaacctggccgagtgtggtgcctgagctgtgagaagtgtcctcagccgacactcacgagggcagtgcaagggagaacctgccagcccagccccaccacagggagagtgcgtcagcagacctgtcctggcctggctggtgttgaaatacacaccggtttgcccaagtggctgttatgggggaatggccgctccagagctggctgtaccccatggtagcctctgaggaggacgctgtggggtgaggtccagggctgcctcctcatggagctgtgtgtgagcaggcgttggaggggttcgagcccctggttctgtatcttcagccagcaaacgaaaccatatcgcaaaccagagctgctggaaaccagcacacgcaaaagatgacgcccagcacagcagcaggacacaccatgtgccaggaaatgacctcagcaagaaacctcaggccgtgtgaagagcagcaaagctttccagaaggcataaaaggaaacttgaataaaggaagatatgttccacattcctggatggaggactacacacattatggaaagacctcattctttccaaaggaatttataggtgtagcttgatttcagttcaaatccccactgggattgttttgttggggcaggcagggaggaataatgttagtacccacaaatgcccatgactgtgcccaatgtgcttctcaccagagccctgcaaggggaagtctcattagccccttgagactcagagaggttaggtaacttgctcaaggtcacacagcactgggactggaagccagctctgtagaactgcagacctgtgctgtttgatgcctcctcactgtcccgtcactcctgggaagaagaaacgggtgagaactgctaagtgatgacaggtggagccccagcaggggccactctattgaatggcatggcccagaccctcggagggccaggcaacaggctagcaaggcccacagggagggagcagaatggagagggcatctcagatgcgcttaaggagcggcgggggcggggcatggggggtgtcacaactaatgtggccactgcttcattctctgggcaaaataatattaaatggattaaagaatctaaaaccagtgggaaaactgtctgatttctggatggcaaaggctttctaaactcaaaagtgataggacaagctacagaggaaaataagtacatagatttgatttctccaaaatacagaaatgctgctgggcacagtgatgtgcagttatagtcccagctacttgggaggccaaggcaggaggattacttgagcccaggagtttgaggctgcaatgaactatgatcacaccactgcactccagcctcggcgacagagcaagaccttgtttctcaaaaataaataaatagaaggaaataaatgtaaaaatgctgcaaattaaaaacctcaaagaagggaaataattgcaacaaatgggaattgatgttgaatatttaccttaaaaacctatacaacaataagaggagtgcgcccttcagcagcatgtatacaaaaattgcaacgatacagagattagcatggcccctgcacaaggatgactcgcaaattcataaagctttccataaatatatttattaaaaaccaataggaggagcacttcgagtcgagtgtaagggcccttcacaaaagcagaaggaacactggcccaaacccccagcaccccggaagcagaggtgagatgggagcagcttgggagccccccattggcgccgccctactggggaagccggtccgtacgtaggccttgcatctcgccacctccacttctgtcctcaagaacaagtcctaggtcaagggaaacagcacagcctgtttataattaggaaacacttaaaacagcctggcatttgggaacagccatgttaacgtgagcaaattcctctcatgaaatagcctgcagctattaagaagcacgtgtgtgcaggaagcggaggcgcaggacctcaccgcgccagcgtgaagttcccgggcatggtcatgaaagcgtggttctgtaagaaatcagagggagaaagggagagaagggggagggagrcaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacattttaaaaattcagttgtctctaactactctttgttatcaaggctggttgagtcaaatatcacaaagtagacaccaatgacttcttaaaaatcatatttacaaagtacaatgggggaaatgcttatactacattaaggttaaaaaaatactaaattgtgtaactgatctggtttcatatatatataaatatacacagaaaaaaatgtaatatatatctgcacagaaaaaagctgaaagaaacatatgccagaatgctagcagtgcttgtatgcgtgcagatgacgcactcagtcagcgcctttacttgtacgtgagcgcttaggggccctgtctctggggaccatgtggggcggtggggcgcttgagacagtgtttccctgcatcgtggccggacctctctactcaatccccagtgttctacagtgaacatgaattttataagcagaaagaaattacttttaagagccaggcgcagtggctcacacttgtaaccccagcactttgggaggctgaggcgggcggatcacaaggtcaggagttcgagacctgcctggccaacatgctgaaacccagtctctactacaaatacaaaaattagccgggcgtggtggccagcgcctgtaatcccagctactccagaggctgaggcaggagaatcgcttgaacccaggaggcggaagttacagtgagctgagaccacaccattgcactccagtctggatgacagagcaagactacatctcaaataaataaataaatacataaataaataaattacttttaagaatcaccaatagaaatctgtctttccatcttttttttttttttttttgagatggagtcttgctctgtcgcccaggctggagtgcaatggcgcaatcttggctcactgcaacctccgcctcctgggttcaagcaattctcctgcctcagcctcctgagtagctgggagtacaggtgcctgccaccacgcctggctaatttttttatttttagtagagacggggtttcatcatgttggtcaggctggtctcgaactcctgacctcatgatccacccaccttggcctcccaaagtgctgggattacaggtgtgagccaccgcgcccagcctttccttccatcttgattgcagtggtgattacacacatgtagacattcatcagaactcatcaaagtatacacttaagtctgtgcattttattacatgtaagtaacacctcaatctgaaaagtatcagggcaacaccacacactgcagaggggcagggctcctccggcagttactcacttcccttgaaacagaagctcaaacatggagtagtcttctgtgactaaacttgttttccgccctcccaacttccaggaagaaccttcttctgaataggatttgaggtaacttaggaaactgctctcaatacggaattttaaagttggtgaggaagtcgacagaaggggaagtcacagtaggaaaatcaaggtactatcaggatgaagtcagcacgcagagcaaggccagcgaggcccaggcgccaggccttggtccctgcccacctcacccaggccagccagacagcacggactgccctacaaggtcacctcagagagatgggggtgttctctcactgctggcttttgatgagcccaggagggctcagccttcactatcctccctaacaggcatttggggtgcagagatgctgacgcctgaataaggttgggattcggggcccttgggaacactgggcacctggtgggtgggtggaggggcaggacgggctgcagccatgtttcccttagaaacagactgctggaattaacgaactaaacaaatgaaccaaggtgcttcaccccccaaaaaagtgagttttgttctgcgtggagcgattgcctttgggaagccaccaaggccacctgccaacaggcaaatgctgtgctgccgtctgcctggctgactccggccctcccagtcctgcaagctcatggccaggacgataacgatgacaggggcaacaccatggtcctcgctgcccttcctggggcaggagggcccagaagactgataagctaaacccagggcctccctcggctgcttatctgcccagcacctttcctctaggtcctctcctcccaccagtacaggggtctgggagggggttgcagggggtcctgaaccacagatccctggagactcagtgggagcagctgtaccaggaatcaggcaccactccgctgctgtaagtctgcgtgagagccactggccagcttcctctgacttccctgtcccctcacccaaatcgatgacatcaggagctaatggcccaggctgccctcctgctgcagtgcccataattcttccggcaggccccgccctgcactccacgaccagcctgggttcttcatcctggtaacctgacaatggatttcgtggggcccactctcagtgcccgccagcctgtgtcctgcctggccaggcaatgagtaccggcggcaggcagctgcctcacccctgcatgacccccccagcccaggggactcaatggcgctgtcatcaaaggggcagctgtagatctaggagggacgtggagggggctagccctgggcctctggcattgtggaggctgacctatagagaacagagctggagctggggagacatgaagtctgcacatctagaccccagtgaggagcccaggctttctaggcacaagccccatgggctccccgggcccagcccctaagaaccacggcagctgcgccaggccactcctgtctccacttccataccctccaaaggagaggcacctcccccccccatggcatctccaatctgaggacctgccacctcccagaggaccggaggccctgatgccccaagaattgggcttggaaagatgttaatatccactgccccaagtgccaaggttcagaggcactggtccaggacacacagcagcggggaagtggaaccctcactccagcctgcagtctgggctctgtcactgtgctgtctctccatccttccctccccacaaccagggctgtaggcccacctaacacaccacacacttcccagaaacaggagtcacatccttttcagggctggtagggtggctgaagatggcccaaaacctcctgaatggaaaaaccttgatggggagactgagggccaaggcagaggtttgtccaaggtcacccccagagtggcggatccaggaccctgggcaagatcttcctactgtccaggcctctcccccacctctcttgtgtggcccagcaccctggactcctccatgcccaggtgtgctccccccaggcacgctgggggcagggtgggcagcaggtgccccccaccaggatagtggctcttcctcctgcagaccttcagccctctgctcctggcaggacactgtggccctcctgcccacgttggtgcgggttgaatttgacggcccagcagaattcccaggcagggcagcctggctatcctccctggtgtctcggctctgagagcggagacccagcctcccagcctggagttgtggtgaattcgcaaacaagtctccatctccagaaccttcctgaagaaaacagctctccaggctggggcaagaagcctgtccctacagtgatacaaccacccctcaataaccccgggcaccacctggcacccactgggggccaccagggagcccaccaagcccactc

SEQ ID NO: 17709 - DNA, 146017 bp, Homo sapiens
cgtgagttttgcttcatcccgatcctcttcccggtctcccatgatgccttcagcagaagatgctttttcttaggagtatgatggagttggatctattttgagaaggcattaaaggtcgaggtgggccaggtgcggtggctcacgcctgtaatcccagcactttggcaggccgaggtgagtggatcacctgaggtgaggagtttgagaccagcctgaccaacatggtgaatccccgtctctactaaaaaaatacaaaaattagccaggcgtggtggcgggcacctgtaatcccagctactcaagaggctgaggcaggagaatggcctgaacctgggaggctgaggttgcagtgagccgagatcatgccattgcactccagtcygggcaacagagcgagactccgtctcaaaaataaaggaaagaaagaaaggagggaaggaaaggaaggaaggaaggaaggaaagaaggaaggaaggaaggaaggtcggtcgagatgggcgtgaggctccaggcaaagctgcctgtaggatgccagccacgtccaagattcatgttctcccaaaagatttcgggaaaatgccagagatgtgtgtgtgtgtgcgtgtgcgtgcatacaaatcccagaatgggttccctaaaatgaggatggctgggggcagtggctcacgcctgtaatcccagcactttgggaggctgagaaatgaggatcatttgagcccaagaattccagaccagcctgggcaatgtagagggaccgtctctacaaaaaaaaaagtagttgggcatatggtgacacacatggtgacacacacttgtgttttcagctattcaggagggtgaagagggaggactgcctgagcctgggaggtcaagtctacagtgagctatgattgcaccactgcactccaacctgagtgacagagtgagaccctgtcccagaaaaaaaaaaaaagggtatcttcatctccccgagtggtccacggagaaaatcagagctggttttcttctaattgattgttattattattatttttgagacagagtctggctctgtcacccaggctggagtgtggtggcacaatcttggcccactgcaacctccgcctcccatgttcaagcgattctcctgccgcagcctcccaagtagctgggattacaggcgcgggccaccacgcccagctcattttttgtatttttagtagagacaaggtttcaccatgttaggctggttttgaactcctgacctcaagtgaactgcccgcctgggcctcgcaaagtgctaggattacaggcatgagctacagtgcccggcctctgattaattatttttattttgatttttttgtagagacgagatctcatcgtgttgcccaggctggtctcaaactcctggcctcaagcgatcctcctgcctcagcctcccaaagtgcagggattacaggtgtgagccagctagcccgctagaactgtttttctgtggccggggaccccagcctctcaccttccctgtcatcactgccctctcctcccctctcgaatatcccgcgtgaggggtttgcacacccacgcccatctcgaccttccttccttctttccttccttccctcctttctttccttccttccctcctttctttctttcctttatttttgagacggagtctcactctgttgcccaggctggagtgcaatggcgtgatctcggctcactacaacctcagcctcccaggttcaggccattctcctgcctcagcctcttgagtagctgggattacaggtgcccgccaccatgcctggcttgctctgcctcctcacccccatttcctctgcatttgtttacaagcatccctggccagagaagggcaccagcagcttgcttctttgctggcgacctctgctgtcagccagggtctacttcaaggacaggatgggcttcccagcccagctgccccactgtgcactcacgacagagcggggtgctttggcgccacgaccaccccagctccctgaacccccttcgacatcttcagcagctctttcagtctaaaatggtgttttcaaacttcaggtcatgaatcaaaagtaagcttaaagggtaatggccaccattaaaaaataaacagaacggaaaatatcggagtgcgccgcaggtttgagatgatctgttgttacgtgtgtgtacacacacaggttatgaacaactgggttaccatgtaaaatgtattcaaaggttcagaagccacttgttggaacaattagtaaaactgtgattctgccgtgcatcagggtccgccccccgaggctgggcaccatggctcacacctgtaatcccagcactttgggaggttgaggtgggcggaccacctgaggtgaggagttcaagaccagcctggctaacatggtgaaaccctgtttctttttttttttttttttgagagggagtctcgctctttcacccaggccggactcttttgcccaggctggactgcagtggcgctatctctatctctgctcactgcaagctccgcctcccgggttcaggccattctcctccctcagcctcccgagtagctaggaccacaggcgcccgccaccgcacctggctaattttttgtatttttagaagagacggggtttcactgtgttagccaggatggtctcgatctcctgacctcgtgattcgcccgcctcggcctcccaaagtgctgggatgacaggcgtgagccaccgcgcctggctgtgaaaccccgtttctactaaaaatacaaaaaattagccaggcatggtggtgtgtgcctgtaattccagctactcaggaggctgaagcaggagaatggcttgaacctgggaggtgcaggttgcagtgagctgagatcgcgccattgcatgccagcttggacaacaagagtgaaactccgtctcaaaataaaataaaacaaaacaaatcaaaaccaaggtccccaccccccacccccaggccacgtgtagcatgtttgagtgagagaagttgccagcacccttcagcccaagttgacccacaggggccagtggtttttgtgtgggaaggcgccacctgaggcacagaccatcacattcagggagagttataagaaaacccctttcctagccccaaagcccctggcactctgccacgaataccttttccttctcactgaaagacaaacaggatggccttctgagctgttgcatgtctgtgagtcacttgagtatctgcatgcacttctccaaaaatgcagcaagcagaacatgtaatgctacatcaactcctgtgagaaatgcgtccaaagatggtgtcggtttgttgttggacgttgccatagggaacagagatctgcctttgaagtacagcgaggagagagctctccttcctgcccatcactgctgccctgtggctctaactgcaggggcgagaacacccgccaccaacccccaaagcagttgccctgcttggggcaaacttctttgtcctgtcccccttcaattccccacagcagaggatcttcagaactgctcaattggagaagaaaaaggaggaggaggggagggagagaaagggagggaataggtctcaccagcagagggctcagcctggttgtgcctgacttcattctcaatgttgctttctaatgctaggctggagcatgaaaagagccgcagaaaaccctctcatgggtctttggaccttctgccttgcttcttcttttcttttctttaattatttatttatttttatttttttgagacagggtctcgctctgttgcccagactggagtccagtggtgccatcatggctcacagcagcttcaacctcatggactcaagcgatcctcccgcctcagcctcccaaagtgctgggaccacaggcataagccaccatcctactttttttttttttttccagacagagtctcactctgtcgcccagataggagtacaatggcacaatctcagctcactgcaacctccgcctcctgggttcaagtgattctcttgcctcaacctcctgggtagctgggattacaggcacactccaccacgcccggctgatttttgtgtttttagtagagacgtggtttcaccatgttggccaggctggtctcgaactcctgacctcaggtgacttgcctgcccgcggcctcccaaagtgctgcaattacaggtgtgagccaccatgcccggtccatgtcctgcttcttttaaaacaaccaaaaatagtccagcctaggaaagggagtctttcctgattttggcaaagttaaaccaggccataggtaacacacagcataaggcaggcgttgggagtgggccccagtcgacagggtgccaggactgtgggctaagcagggctggggacatgggaggcctcagtgcctgggctatgggaagtggttgggaccctgagcctgaggtcagtaacatcccaactcctgacaggcaagaaagggcacctgaggctcccaaggggagtccaccatgggggtgggggagaccgctggagtccataggtccctgtgagggacggcgaaggcgggcctgtcacctctaaaagagctgtgcctgtggcgcagacgggggtgccactgtggcctggtgagtgtggctgtagaacaagcatctgttgggctaatggagccagagacatggtccaatgtctctgatgtccagatagacttccagcagccaggtcggactatctggggttctggaacgttccatgggtgaagctgtaggaggagatgctggacttcctgcctccactcacatgagtcactggagcaatacaagaaggcagactggccttggctactcacactggtctcagctctggggtagggctctttataagccttcttgagaagtgaaaaatgcaaagtcctttctgtcccctcaccactgacttgcaaactccagcgaaggcctcacccctcagctggcccagagcctcccagaagccctcccttcgcttcccacctcgccaggcccagccaggctgggtgctgccttggtgggcctaggtgaatcactgacacaccactgatgcctttggggcagaaggcagaggcctcgggagaaatgcgcaggccccagcggcctggtggagggtgcagggggcgcaggggcagccaggaccgccgaggacgctgggggcacgtggcaaactggctaccctgtccacccgtgagcaagacaccactccgggggcgtgggagggtccaagggagggagaaaggaaagtgccaccaaactaatgtggagccctgccctctgcatgcgaaaagggctccacggcctgagtcaccctcagccccacctgcgtgtgcgcgagggtgcgtggcctggtacgcgtgcgcacggtgttggtgagcgtgtgtgtgcgtgtccgcttgaggggaatgtgaccgtcgtgtatgcgtccgcgacagtgcggggggccgcatatcggacccgtgcgtgtgcgtaggggtcgcgtgtggccatgggcacacgggcgtgcacgcacgggggctgcgtatgctatgctggcgtggggggtgcgggcgaggtggccgcggggaggagcggcgccagcacctatcggcccccacgcggcctgcgtggctttttgacccggaaaggcggggagcggggacgcggggacgcgcggcggcgggggcgcggcggcggcggcgcagagcgaggaggcccgcggggcgcgcggcggggacaggagggaggcggggggcgcccggggccgtccccgccccgcgccgcggcgccgccgttgctaaggccgggcgggcggccgccgggcgctagggcccttagcaacgggtcgcgggcgcgcgcggggggccggcgggcgcgtggggccggcggcgctcgcgggctcctgccgctcccacgcgcgcgggcggcgggggcggggcgtcggccgcgccggggatttccagcgcgcgagaggaagtgcctgcgcggggctgcgtgagggagcgagggagcgagggagcgcggcgcggccgccgcgtgcgcgagccggggttgcagcccagccgggactttccagccggcggcagccgcggcggccgccggctcttccccgccccccgccatggggcagcccggggagcagaaygctgcggaccgcggcggaggacgcgcccggcgcccctgagccggccgagcggcgacggaccgcgaggtaaggggccgcggcgggcgggcgggcctccggcgcgcggccgggcgcctccatccccgtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcaccttttcaggaaacggggcgcgcaggcctcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagccgttgacgggaccagttgtatttcacgtttttcgaattaagctcagaatcagttttcagaatgacatgtgatgcgtggtgcgtggtgtgtgtgcctgtgtgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagctttttttttttttttttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagargcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacaggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaaaagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattctyaagawctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagtttyatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggccttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttyaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattckaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtgraggtggtrgcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaawaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgtyttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttgttttgttttgtttctttttcatgtcatatgggtaatgtgccgacgtcataacaaggtttcagagtggcacctctcacaccttcatttgaatacccaatcacacttatgaactacaaaaggatatakgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgccsaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgatttttttttttttttttyttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccytcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtwatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccrgaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgccctyggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagcttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaacgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcrtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcartggtgcgatctctgctcgctgcwacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgytcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcrggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggcygaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctctctctgtcgcccaggctggagtgcagtggcgcaatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttamcttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagygacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttwtctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccagtcccatcatgggggagtttggaggccaggagattcactggatgcttcttttctagtgtrtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttrtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccagrcctttctccatgctgctgtcagagagatctaaacataggtggcctcctgcccttccctgaaaacmctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatggrtgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagacttttttttttttttttttttgagacggagtcttgctctgttgcccaggctggagttcaggggcgcaatctcggctcactgcaagcgccgcctcccaggttcaygctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttatraagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggtttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacrcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaacctccacctccaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccrtgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcrtggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggktttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcggctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatataatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaaygtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccrtttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttrcttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatattttttttttttttttttttttttttgacaggttcttgctctgtcacccaggccagagcacagtggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcrggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagcctcagyctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctkcagatagtagggttgccctttagcattttaagtgtctaaatgagacctattgggatgtttccatagtttgcatcaaattcatgtaaatgcgcrttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaggcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcrgaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaayattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagyccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaaktgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatasagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaaaggaaattggaccccttccctacaccatgyacaaaaatcaacaaaagatggattaaagactgaaatgtaaaacccaaaactataaaaaccctgcaagacaacctaggcaataccattctggacacaggaactgacaaaggtttcatgaagaaaacacmaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttktgtgtgtgtgtgtgtgtgtgtgttttttttgggggggggtgaaggtcttgctctgtygcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcaggktctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgccyttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcwtttgtttactaatttatatccatttgatacacatctaatgattgcctctgatgggtatatgtgggaacatgtacattccctactgttagctgcaaatagtgagaagtarttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggartattaaaggaaattcagatagaaagaaaataatatttgatgggaaaaatttttatttatatatattttggagacaggatctcactctagtgtccaggctggagtgcagtgggtgtgatctyggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgckcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatmctattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttktttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctygccaacatggtgaaacccccatctctactaaaaatacaaaaaaattagctgggcatggtggcacackcctgtaacctcaggcaattgggaggctgaggcagcagaattgcttgggcccsggaggyggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccaratagctgggactacaggtgtgcaccaycacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttattgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagsctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcmcaaaaaaaaaaaaaaaaaaaaaaaattacagccatccyagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcytctcctcttgaggtcccaagatggcgtggggytcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtckgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctcagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgygcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatamgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtyataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatwgaaggtcacggggctgcyggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgyagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggccygtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactmaactgttctacttggtaacttccttttgaaaaatcagcattttraaaaatgtagcccttttctcccatggcttcctatgtaaartgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggtttttttwaatcattttgtcacrtgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccrcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcayggctcactgcatcctctacctgccaggctaaagcagtcctcttgcctcagcctcctgagtagctgagactgcaggcgcatatgctgccttgcccagcwaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaaygctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggamtaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggagracagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaaygcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgsgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcargttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttscgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaayagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttcygaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcycttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaayagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaacygaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagcckttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcartgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcarattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagayggtgattgcttcaaaagatgtctcttgacttggccaactgtgccraatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcytctggggtggagaccaccaccccaatggatagacagagacactcgttaatagatgggggatcaagatgccctttgtaaamatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccarcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaartgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattytgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtktcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctccckctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggyggcagaggttgcagtgagcaaagattgcgccattgcactcgagactgggtgacagagcaagrctgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgrgactcatgcttcatttcggggtttgctaagttacaaagggygtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacagggrcctctgactgttctgctcctagsctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagygcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagygagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctstccctttacagccagcctttctacactggttactttggytataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaawgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcargcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctyggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaargggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagmctccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcagrctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcrgtgtcgacgctgcacagcatctgcagatkcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtgtcttggtccagagcagataaggcggagctctgacctcctgcccggacacgtgcccgccatctggcatggtggaaagggcgtgctggacccacaggcctggggtcagtctcagctccacgacttcgtgggactttggaatcttcgagcctcagtttcctcctctgtccgttggaaggacagcacctccttccacgccgaaacaaggtggttaatgaggagtgacaccagtgctgatgtgcaggcggctgcagggtctgggcagtgtccttctggcagctgctcgtggcagttaagggctcctgggctgtcaccgccaccatggcctgccttccatttctccaggaagttgtttgggtcaggcctggtagcaggaagccctgcatctcccccaaaattatcagatggggagaaccgctcagccctcccccactgtcctgccactcccagggtcccctgcagccaccacagcgccctgctcagtccctccccatccttcaaggcactgcatggggccacatccagaacagatgccatcggtccccacrtgtggcccactgagcagggaggagtggacctaggagcagcaccccagggtcctccctcagggtctcagggcctctcctgagggtcccttgccagcgcagcaccagccccgccctctctgcgggcccacaccacccctgccgtgccctggctggtggcagtagtggggcgctggaatcctgggactggcagcctccaccccacacacgatggggagcctgtggtaccttggctcccgggagctgccccaggacacagccttgctggtccttccgtctgggggatcccaaatcctcacacccctgtggtgggggcctgcgctccatccatctccctgggcgctcaagcccagggtcctgccgcagccttgaggacaccgggacacctatggagaccaggcagtgtgcagttgtcaccgctgaccgcaagtgtgagctgggccgggggtgggatggcgaggacagccagcgcgatgtgccgatgaatggggaatgtcagctggaggcttgagggattgcagaaactggattccttttttttttttggagacggagtttcactygtcacccaggctggagtgcagtggcgcaatcttggctcaccacaacctctgcctcctgggttcaagcaactctcctgcctcagcctcccaagtagctgggattacaggcatgcgccaccacgcctggccaattttttgtacttttagtagagacggggtttctacctgttggtcaaactcccgaacacaggtgatccgcgtgccttggcctcccttttttttttttttttgagctggggtctctctctgtcacccaggttggagtgcagtggtgtgatctcagctcactgcagcctcaacctctcaggctcaagtgatcctcccacctcagtctcctgagttgctgggaccacaggcgcatgccaccatgccaggctaatttttgtatttttaatagagacggtttcgccatgttgcccggggtggtccggaactcctgagctcaagtgatccccccgcctcggtctcccaaagtgctgggattacaggcgtgagccacccccggcctggattcttgcaccctcctgggagtcctacaggagaggagatgggcggcaaaccccaagacctgctggactggcctgggctgagggtgctggtggggacatctgcagagctggcctcagatcatgcagcaagaaacggcgggggggaggaaggggagcttctgagctgctccccccagggcattgggcagggactccctgcccccagcctgacgtccagacctcaagggggttggagggactgagtccagccctcaggtgcacaccgggccatcacctggctccgtcctgctgtggggcagcccagatcttgcagggaattgggaaccaggggtgtcacagtctaggcctagggaaggaggaggccgtggccctcgcctgcctcccctcagctcagggggctgctctgttctggcccagatgagtgatgccggaaggggagcggtgcagagcagggaggcacacgctcagagccctccgtggccctgactctgcactgcagcagcccccacgcccaagagtcaacccagcatccaaaccagggaagagtctggactgaaagcgcaaccgtacttggtgagaggccggtaatctcgagttctggtaaggaaagcaaggcctggggcggaggctggggctcggctgctgggctggatcaggcggcacacccggctcacactgccctgcagtcctgtgggagacagcggcactcggacccgctcacaagccctgcaggacaccagtggaaccacatgggtggaagcctagaaatcagattctgaattgaagtccagggggttttctgttttctgaaaatgagtagttgcataatctaaccctaaaatcaaccatttcttgttaaaagaccagaagaaccaaagtgctgtgcaggggaggtgtccgcgccgcctatgctttttgtcttagttttttaattttcaaggtcatccttaaagcctctgccttgaccctgcagccacaggtgacttggaggctggaggccaggcctggggtctgtgtccttcaaataaatgcctcagtgccgcttgggggactcggtcctgtgccggagttactcgattagaagttaaaggtggaggggaaagacacctgtggggccatcccaacccacttcctccactcagaccacagctttgaatgggctcagtccccagggacccccaggccccagggtcagcctcgcagggcagagctcagaaccccctgcccagaccccagggagccaaaggggcccagatctgggcacagggcaggaagagggctggcacctgctgggaggggtctaggagccaggggcacagctcacatgagtgcatacccagcacctctgcttcatgtcaaagggagatgatgctggcgtccacccgagaggccacatggaaagcactcgacatggacaggacatcgcccacaggaaaaacccctgcaagggaccttggaccttggggaaggcggctgtgccctcccgggctgggccttgcaccctggcctgcagccattcggctcggaggactcccggcacccacaggcacttggctcccgccacttccctggcccctgtggcacttggggctccacagctctccgactccctgctgagggttgagccgtttgcaagcatgtgtccccatgtgtgcttgagggccgggggcacctgtgcatatggtcaagggccttctgtgcacacatggcacctgcagtgtggtcccagccgttcctcagcacccgtgggcccagctccatctcgggcggcctgcttggcgcagctctcgctggtcacctcgtgccgggtgactgctctccatcagctgtgcccgggctccacatacatagcccgggtcacatccactcacgtcctggtccagccagccttgcggggactctgcccaaggagggacagtaagggtttttgagtaccaagtcagtgaccctgactgccagcagcggctcctcttgacccggaggccggtgaacacctgacaacatttccctccatacagcgcaggggcaggggcagattaaccctccgtgcggaaggaggagtggaggtggaggcgggacagtggctggcccctggtccaagtcttgcagagccctccccatctggggtggggttgaagcaagtcactcaggggcagcttcctagctggtgctcccgagaccctcagctccccaacaccctgatgtcctcctccttcctcccattgtccatggatggagaagggaccaacggttcctccggggctgagctctcgtctcctggtgctcctgcttccctaccccccmacccccaggccagggctgcagcctgaaggggcactgggtccctgcgccctgtgagatgggcgctgccacccttgctctgcaggtgacgaatggaggcgaagtgaattgcagtgtcatatggcatttgagtcctagacagcgcccaggactggtccgaccaccgctagatgccaccaggggggctctgcctgtcccccaccccagcagacagcaggcccagccccatccaagctaggtggagacccctggtccataccctcctgggcttccctctgagttgtatccaacccacccagcaacagctgctctcagcaagcctcctggcctcacctgcactctcttccctcctctcctgcctcttgccttcctttttttgtgagacagatcttgctctctcgcccaggctggagtgctgtggcgcaagctcagctccctgcaacctctgcctcctgggttccaacaaatctcctgcctcagcctcccaagtagctgggattacaggcacccatcaccacgcccagctaatttttatatttttagtagagatggggtttcaccatgttggccacgctgatctcgaactcctgacctcaggtgatctgcctgccttggcctcccaaagtgctgggattacaggtgtgagccactgtgcccagccaccttcctttaaaaacaaaaacaaaaaaccccaaaaacctgaggtcttgctctgaggcccaggctggggtaatcgcagttcactgcagcttcaacctcctgggctcaagcaattcttcctcagcctctgcggcgccgggaccacaggcatgagccactgcaccgggtgttcttggctccctcgaagcatccctcatgttcccgtctcaaggccttggcgggctctttccctgtcttgctgatgtcccaggcccaccccaccttttccctggccctgccatgtgcaggaggcagggctgtcactcttgctgcctccacacctcaggggaggctgtgagccagcgtggccagtcagagcacagcaacctcaggctacaggaactggtgcagagttggagacaggaaccaatcagagacctcactgagaccctcctgccatggcctggtcaaggaggtggtgagtctcactctcccaagacaccttccctgccacgtggagaaggccgtgcacacggaaaccaacacaggagggccgccagccatagcggagacagacacagggaccaagagactgagacagcctctagatgctgaagcctgcgctgaagcagttgggccgtgagaggttcttcttactggaggaaactccggggctttgcatttctccacgtccctgctgaggttctgagccatttgcaagtttgtgccctcatgtgtgcctgagggccgggggcacctgtgcatatgctcaagggctttctgtgcacacatggcacctgcagtgcggtcgcagccattcctcagctcacatctttgcatgtgagtggttctggtaccgcttgtctgcccagcgccctggtgcctatctgctgcctcatgtgagctcgctgggccaccctctgactgctggacccacctccagaggccactcagggcaagagagatggatcccaataccccacccagccagccccagccccctatggtctgccaccttcaattcaacctcctcactgtggctgcagctgtgatctcatccttcctgtctcattttaatgccacctttttcaggaagcctcccctgaccaggaagccaagtggcctcactaccctctccacacagcacaatctaggaatggcctg

SEQ ID NO: 17710 - DNA, 146778 bp, Homo sapiens
atttatccatttagccataggtcccaattttgactagagcttctgcagtcactaccacaaactggccactactgctaccagaagcattgttttgcaccagagatcagcaaatttttccataaaggtctaaatataatattattatattacaaatattttaggctttgttagatgtaatatcactgtttcaaatatccaaatctaccttgtatttgtgaaaggagccatagataaaatttgaatgattgaacgtggctgtgttccagtaaaaactctaattacaaaatcaggtggcaggccagattctacccacaggctgaccctagttttatactatctatccaatagttggtctttgtatcttatagaggcggaatatgaatacgacatgttgccaatatgatgagatggtctttatcccatgtcttagagtttaatgagttataccacaacagttgcttcatcttccaatatgaaaagaagcaaaacctcaggatccaccctacaggagtccctccaacagaattatcatcaagtgacactatctccagagttacgaatttgagatgagaagcaaacagtaacagaatttgaaaagaagattctcagttttctttgggaactaaaacttggttgcttttagaacccaggatacctttctgagggtgatccacaaactctgtctacctctgccgcctttttataagtttggcacaatttgaaagttttattctaccagcctttaaaaagttttattctaccagttatttggaagttgttttagaagagcgttggggatgtttggtggtctttggacataagtttctccatcctatttgttaggatggacaacaagctcactttttgccgtgactattctctgtcttatctataagtgcgtgtgtgcgggagcacgtacacacacacacacacacacacacacacacacgcgtgcgctgaggcagccaaacatcttcatagctgcttccctgatgtatatgcttgcctagaacttttacttgccagcttacaggactagtatcttcaacatgatactgagtttcatcaacagagaaggggactgggacacttttcgttgggcagttgcggatttctggtagactcactggcaaattgaagaggagtatgagcacaggtctttaagtacaacattatgtgtggtaaagtagtactgaaagttaagaaatcgcattgaatattgggagtagagtgagggtcaacagtgacaacttaaaggactctatgtttcactgttgctgagggaggaatgatgaccttgggtagatatttattcaaagaagagtattgtttctgattaaaaaaaagagggaggttgatagacacaaagaagcaaggaaagaatgtgtttttatgactaagggacattatcagtgttttagaaacactttatgcatggttaataaattcgtttgtcatataaaacaggcatttttgtgtattttggacaggcccatctaagtcacaggaacattattttgtgtaaaaatttaccagagtaactaaggtactagggaaaatagtttggtgccttaacaactccttatctgaggagttgccacagaattttctaaacattccccctatagaaagacttccagaaaagctcagtcagtaaacctttcaggctctctcccaaatatgttctgaatgtgtgcagatttttactgtcagttgcaccaaacttatacccattgaccatatcttgcctgggcttttgcagtagcgatttggctctactcttccttcccctggccagtcctgtctccacagagcagccaaaggctttttttttttttttcatttatttttattttcattagacagggtctctgtcacccaggttggggtacagtagcacaatcttggctcactgcagtcttgacttcccaggctcaagtgatcctccagctcagcctcctgagtagggagtagctgggactacaggcactcactaccatgcctggctaatttttgtgttttttgtagacacaggatttcgccatgttgctcaggctagtcttgaactcctgagctcaagtgattcgtctgccttggcctcccaaagtgcttggattataggcatatgccactgcacctggcccaaataggccttttgaaaacacaaatttgatcaagtaatttttctgcttcacaccctcctatggattcccatttccaatagaatataatcctaactccttgctgggcatagtgcagtacatgacctggcctctgctcaacgctccaactgcatcttgttcctctttcccctcggtgaggataactctctttctccaactacaccaaccttcttatcaaatatgccaagcttgtttccttccatcctaaggcttttgcatttgctgatccccacgcttgaagggctctgtctctagatattcacgtattttttccttcttatgctttgaatttcatttcaagcattatttcatcaaggatctttccagtccactcccaagcccatcattctgtttgattttcttcagagcacttttgccttcctgaaattattttgttaaattgtttcgtaaaagccttggatgatcttgacagaagatgaaaaagtgaaacaaggaggtaggtatgggtgggagccaggcatggggccagggtgcttttgaacatacgcaatgtgtctatgttttcttttgagaaaagatgggatatataaactaccatatgttttctgtggtttggttcttcactgctttgaacattctaacagtttatacatatttcaacaaaagaaagagaaagaacatgcatctgtctccaaaattattttaagtctctttcacatctatttgctaacctaatatcaactactgagaggcagtatagtgtagtggtctgaagctgactgaatccccattcttctgcttaccagctgtgaaatcttggggatgataaagcctatctgtacctgtgtcctatctgtaaaagtgggataacaatagtacttatcttaaacatttgttgagaggattacattagttaacagccctgtgttcctagaatgacctgtggcacatcataaatattcaacaactgttaactctaatttttaccagagaatagaaaacaatcctgccgcttgaagcttctcaagagaaatgaaagattgaaatttccatttccactccagatgaggtggcaggagtgatcagggctcctccccttacttttgaagccattcccaggttttgtccatagagcttcactactggcagatgtttttctgtctgtccttcttcaaactacttaaatagttggaaatagtgaaagaagtctcatcatcagcaactgagaagcagtacaagtaacatctgagaaattctaaaagggattttagaaaaaaatgttctgacttggttaccaagtgttgcgcgtgcatgcacgcatacacacacacacagacacacagacacacagacacacacacattttaaatatatctactcattcaacctagcaaaagaaaaggattccctcttaatcttaattgttgacttattttctttcttccttcaaccagacaaaatccatgagtagtaatttagactcttttgcttataacaatatctctaggacctagaaatatttggcatggagtaggtgctcaataaatatttcttgaatgaaataacaacatcagcaactctttgaggtaggtgctatgattatcctgtggtatatgtttaaaaatgaggttaattaacttgtccaagataacagctactcatgctagtgctgggttcagctagtgcttttaaacattccatagcattgcatcttgtttctccctttaaaatatcaatccacttaagtctttagtccatctggagttaatttttgtataaggtgtaaggaaggggtccagtttcaattttctgcatatggctagccagttctcccagcaccatttattaaataggaaatcatttcaggtttgtcaaaggtcagatggttgtagatgtgcggtcttgtttctgagatctcttttctgttccttggtcgatgtgtctgtttttgtaccagtaccatgctgttttggttactgtagccttgtagcatagtttgaagtttgggtatcatgatgcctgaagctttgttctttttgcttaggattatcttggctatatgtgtctatacttgtctttttggttccatatgaattttgaagtagttttttttcaaattctgtgaaaaatgttaatgatagtttaagactcaaatgtaaaacccaaaactataaaaaccctaggggaaaatctaggcaatattattcaggagataggcaagggtaaagatttcatgattaaaatgtcataagaaattgcaacaaaagcaaaaattgacaaatgagatctaattaaactaaagagcttctgcacagcaaaagaaactatcatccgagtgaacagacaacctacagaatgggagaaaatttttgcaatctatgcatcttacaaaggtctaatatccagactctacaaggaacttaaatttacaaaaaaaaaaaaagccattaaaaagtgacccaaggacatgaacagacacttctcgaaagaagatgtttatgcggccaacaaacattttaaaaagttcaacatcgctgatcattagagaaatgcaaatcaaaaccacattgagatatcatctcatgccagtcataatggtgattattaaaaagtcaagaaacaacagatgctggagaggttgtggacaaataggaatgcttttacactgttggtgggaatgtaaattggttcaattattgtagaagacacggtgataattcctcaaagatctagaaccagaaatactatttgagccagcaatccctttagtgggtatatatccaaacaaacataaatcattctgttataaagatatatgcatgtgtgtgttcattgcagcactattcacaatagcaaagacatggaatcaacccaaatgcccatcagtgatagactggataaagaaaatgtggtatatatacaccatgtaatactacacagccatgaaaaggaatgagatcatgtcctttgcagggacatggatggagctggaagccattatcctcagcaaactaatgcaggaacagaaaactaaacaccacatgtttctcactaatagtgggagctgaacaatgagaatacatggacacagggaggggaccaacacaaacttgagcctgtcagggagcagggagggagagcatcaggataaatagctaatgcacgtggggcttaatacctaggtgacgggttgataggtgcagcaaatcatcatggcacatttttacctatgtaacaaacctgcatgccctgcacatgtatcctggaatagaaaataaaataaaataaaataaataaatccaactatcttatccactccattacaaattacacctggatatgaccacctaattactttacatagcccctaatcttttactcatcccatccagctagaaagttactgatacaataatctgtagacactggttttcgcatctcagtctactgttcaaaaatgtcagtggcatcccatagaaatgaatatccttgtccgcatcaactctgttttcaagcttattcccgttttggtgtcattttttcttagatatccagctacactgaaagttgaactcatgctcaaatatatgtgtgtcagtttactcaatgagtacattaacatattatatttgatttacaagacacttgttaaaggtgccttaatcacgaaagaaaaaatctgagaaaattgaggctcagcaaagtttagtgccattaactgaggtttttcaacagggtattggagccaaagccacgtaagagttaactgtttgaaaaaacaaccaccaaaaaaaaaaaaaaaaaaaaaaagcaaggaggagcctctggttccaagtgagtacagtaatcttagaacctgttcccaagattataacctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaaggtaaaagtccttcatttatttgggttgttgtgggttgcaatttagtcatttgtacttggaaaaatataaggagatttaatgcttagttataagtataagattctttgggttttctaattatcttgtttatacattcctgacagcaatgacaattgtatttaatgcaggatttgttttgtgcggtagtaataatattgtttgtttatgcatgcacagatacagatttacattttgagttttcaaatatgtagttacaagtggcttggagcgttagaagtacatttaaatgattccggataatgttgttttcctcctgccttgtcattggcctggaaagtccctttttgtttatccagttcttccacaaccatcgttcaaattctgatcaagccccgtgttcttcacatgtctctctctctctggaaatctcagaacattagttgtctataacatacatatctacacacttaacactcacatatacacattctactggagttttcttttaaaattcaaaaatgagaacattattttttcaaagctaagtaacagaagagtatataaaaaagtcaattttgggcgtatctttttacatttctttctatgctcatgtaaaacatacatgatttatgtaattatacacatatgctcccccacaaccyttagtcacaaatacaggatcatcattacctacatatgtggacttgttgctgtaatcatttaactatgaactatggacatccctctaggtcagcatgtatatctaaatcrtggttagtccctaaatccttagataagaatatctatttctgcagaatggatttccaaaagtggaatgccagaaacattgtstactgcaatatgcaatcccatcacttctccaccccattccattgtatgtgataaatctttcaaaaaatttttaattaactgtatgcaaaaataagggtattgtgctacttttcaatcgcatttccttaaataccagtgagatttagcatcttttataaaaagattataataatttttgtctatttgcattttcctctcttataaaccccagttcatacaatttacccatgtttgctttttcttttcaatttgcagaagttctctattttacattagggttataaagctcacctctcatatacgtttcaaacatgttctctattttttaaaaacttatttatggtactttttgcctttgtataaatctgtactattaaagaagtagactccacaatttttttccattatagtttcttggttttttttttttgtcttttttaaaaaagtttttctttaacctaacattactcttayttttcacataatttttwcattttattttaacattaaaatccctaatccattgctctttttcatctttaaacatggattatgcaggaatattactattttcttgctgaatgaagatctaattataattataaaatcatttactaaagaagctatactttctctgctgagctattatatatttattatgtatatgtatatttctgctgaagtgtttatcatataatacattttcatttatatttatattggatacagttataaactcagttttgtacagtaactagtacaytttttgtggtcataacatgttattgtaatccaattaatatcacagaaggctttagtatcctatgtcaggtaccgatcatctttttcaatatttttaggtaaatcttacatatttattcttccatataaaattttaagtcaaacaaaaaagtagaaataaacaaaataaaaaatgattaaaattaaaaatcatttaaaattataaaggaaaatccaaataaaaattagtatctcaataaaattatgattaaaattgcattacatatttatacttatttaggaaagataaaggttttaataatattatggaggttttttggtccagtaagcatgataatttttcttaattcatgcaagatgaccttcaatataaaattttgtattcttcttcatacagttgcacatttttgttaaagttttctggggtactttattgttcgattgttattgtgaatgatattttatttttattttaatttttgtattatactgccagcataaagaaaagcctttggttttatatattttgtatcatgttgctgtatcaaattcttttattaattacaatataggaacttttttgtgatttacaagtattagtaattgtctataattaaatatattttgtttttaatttactgtatttatgtattattttcattttctcattttcttgtattagctaatgcaagaaataccacaacagtgatgaataataatgatattagctgggaacctttatttgttcctgattttttttttgtctttttttttattattatactttaagttttagggtacatgtgcacattgtgcaggttagttacatatgtatacatgtgccatgctggtgagctgcacccactaacttgtcatctagcattaggtatatctcccgatgctatccctcccccctccccccaccccacaacagtccccagagtgtgatattccccttcctgtgtccatgtgatctcattgttcaattcccacctatgagtgagaatatacggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagagccgcaataaacatacatgtgcatgtgtctttatagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcatctgttgcttcctgactttttaatgattgccattctaactggtgtgagatggtatctcattgtggttttgatttgcatttctctgatggccagtgatgatgagcattttttcacatgttttttagctgcataaatgtcttcttttgagaagtgtctgttcatgtccttcgcccactttttgatggggttgtttgtttttttcttgtaaatttgtttgagcccattgtagattctggatattagccctttgtcagatgagtaggttgcgaaaatttcctcccattttgtaggttgcctgttcactctgatggtagtttctttcgctgtgcagaagctctttagtttaattagatcccatttgtcaattttgtcttttgttgccattgcttttggtgttttagacatgaagtccttgccaatgcctatgtcctgaatggtaatgcctagcttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgttttcctcaggtttgtcaaagatcagatagttgtagatatgtggcgttatttctgagggctctgttttgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagatatacaatcatgtcatctgcaaacagggacaatttgacttcctcttttcctaattgaataccctttatttccttctcctgcctaattgccctggccagaacttccaacactctgttgaataggagtggtgagagagggcatccctgtcttgtgccagttttcaaagggaatgcttccagtttttgtccattcagtatgacattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaagaatctctttttttgttgtgtctctgcctggctttggtatcagaatgatgctggcctcataaaatgagttagggaggattccgtctttttctattgattggaatagtttcagaaggaatggtaccagttcctccttgtacctctggtagaattcrgctgtgaatccatctggtcctggactcttttttgttggtaagctattgattattgccacaatttcagmtcctgttattggtctattcagagattcaacttcttccttgtttagtcttgggagagtgtatgtgtccaggaatttatccatttcttctagattttctagtttatttgcgtagaggtgtttgtagtattctctgatggtagtttgtgtttctgtgggatcggtggtgacatcccctttatcattttttattgcatctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttccatttgctgaggagagctttacttcccagtatgtggtcaatttaggaataggtgtggtgtggtgctgaaaaaaatgtatattctgttgatttggggtggagggttctgtagatgtctattaggtccgcttggtgcagagctgagttcagttcctgggtatccttgttgactttctgtctcgttgatctgtctaatgttgacagtggggtgttaaagtctcccattattaatgtgtgggagtctaaatctctttgtaggtcactcaggacttgctttatgaatcttggtgctcctgtattgggtgcacatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtctcccgaatactgcacactgatgggtcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttgccatgattttgcagcagctggtaccagtcgttcctttccatgtttagtgcttccttcaggagctcttgtaaggcaggcctggtggtgacaaaatctctcagcatttgtttgtctgtaaagtattttatttctccttcacttatgaagcttagtttggctggatatgaaattctgggttgaaaattcttttctttaagaaatttgaatattagcccccactctcttctggsttgtagggtttctgctgagagatccacttttagtctgatgggcttccctttgagggtaacccgacctttctctctggctgcccttaacattttttccttcatttcacctttggtgaatctgacaattatgtgtcttggagttgctcttctcgaggagtatctttgyggcgttctctgtatttcctgaatctgaacgttggcctgccttgctagaytggggaagttgtcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccatcgctgataccgtttcttccagttgatcgcatcggctcctgaggcttctgcattcttcacgtagttctcgagccttggttttcagctccatcagctcctttaagcacttctctgtattggttattctagttatacattcttctaaattttttcagagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttccaacagagaggaccctcagctgcaggtctgttggagtaccctgccgtttgaggtgtcagtgtgcccctgctggggggtgcctcccagttaggctgctcgggggtcaggggtcagggacccacttgaggaggcagtctgcccgttctcagatgtccagctgcgtgctgggagacccactgctctcttcaaagctgtcagacagggacatttaagtctgcagaggttactgctgtctttttgtttgtctgtgccctgcccccagaggtggagcctacagaggcaggcaggccttcttgagctgtggtgggctccacccagttcgagcttcacagctgctttgtttacctaatcaagcctgggcaatggcgggcgcccctcccccagcctcgctgctgccttgcagtttgatctcagactgctgtgctagcaatcagcgagactccatgggcgtaggaccctccgagccaggtgcgggatataatcttgtggcgcgccgttttttaagcctgttggaagagcgcagtattcgggtgggagtgacccgattttccaggtgcgtcagtcacccctttctttgactcagaaagggaactccctgaccccttgggcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatggtaagcaattgttagtgaaatagtagtggaaggatctgttattttatgtgaattaatctttttagcaattgatattattggcttgagtgtaccacccactcccaggtgttgagaaatatctaaatatctgaagaaaaaaactgttatacaagcctctcgatgggataatttactattccccaggaccagcattctaagcactttttcttctctgtgcacagtagattttgtggaggtggccgtatcaccttgttcaggaatagcttgctctaactgcagtatgtctccctgcacttttctttttcttttttttttgttttttgttgkgtgtgtgtgtgtgtgtgtkcgtgtgttatttttgagacagtgtctctctctgtcacccaggctggagtgtggtggtacgatcacagctcacttgcagcctctacctcctgagctaaagagatcctcccatctcagcctccccagtagctgggactacaggcatgcactaccacttctggctaatgtgtgtgtgtgtgtgtgtgtgtgtgtaaagatgtggtttcatcatgttgccaaggctggtctcaaactcctggacttaaataatctgcccaccttggcctaccaaagtgctgggatcacagcccactgcactgacccaacatttcatattgttgctgagccactaaggcaagctgaccagaatgggaagaaagacatacatagacagtgtcttttgaagcactgtcttgttcatgggcccgtgtttctttcttgaaatctattagcacctgatctggaaaggcagttttcacttacagaaaccctagttttatcttgtctctatgaaggtcactgtgcaatattgaaccatggctgtgctctgcttattgctagattgatacaaggtttattatcagttctgttattgttttatagaggtaagcactaggaaatatgtttacatgaagatgttgttgaaggaaggcattttactacagtaatgtcgcttggttatttgaaccctctgtagttacatgtcaaaattcaaattgtgttgcaatatcaaaaattactgtsaattgataagttggttttctttcaagtttgttgaaaacaatcaaaatttttacagaagaatatgttagttattagaatctttcattttgccaatttctgagatatataccttacaattttatctagattgaaaaaaggattastaaccgtatctgtttatctcttacagtcacctggtttttgaagctacaagtagattatatcagcctaaaaaaattaaattgggcattgtctattgcagaattttctttgataagctgagcaaagatttatttatctttgccaaattaaaaatttttaatccggctggtctctaagcagcttcaaaaatcttgacagagcaacagaaataaatatttttgagaattttatatctatattgattagaatttctttcacaattgaaaatggttgtttcttattatgcatctaatagaatcagtgtatatcattctctgaacaggagtaattaatcttaaataaaggaaactggttttctaaggtttagtgcattgttacctagattgcttttggggatgcaatgaaaatcactgtgcagtgtgaaccatggctgtgttctacttattgctagattgatagaaggtttattatcggttctgttcttattatgtgatcttgatctttatctgcatatacatatatatatattctgattttaaatgtacaatgaaatcttctgttagaaaattaactacaaaacctaaggtatttggccagtgctaaacaagagacttagagaaatatggtctcatgtgattctgcyccaggaggcatgaattatttgataataggagaggaggatgaaatgtgccacagtaagatttagaataggtgagagataagtccttccttttgtaacatttggaaaggaaattatgcaggggtcaagggttgggaaagaaggactagcatgatgactaaacttaagatacattttcagagaggttggcttttcaaaagggtctacatggaaaatgaagaattgaaagtgacttctcttaaaactattcatgttcatgtacccattggaaaattttatgcattctaaatattcatataccttggtttggagaacctattttagaccacctagggaacttgtaaaagaaatgtacaagaagaggttttatgaaaactctcattgccagcatgtgtaacaggttgtagaggtagagaggtgcactagagatcaaagggtagagataaaaataaaagtcrtttctgtagagagagttgtgctgtgtgtcccactttcacttctgttagggggaggtaagctattctttcttctgatttaaagcctagtgagcatgactttaagtttgctcagagtgctttatatttgtcctctgcagtttgggagacacaggggactggtgtccaattcatacttmggaaatttaagaagcctaaaaggcaaaaaggctgtggctggatccacctgccaggaggtgaattgaagagagggctacatttgaaaaggagcttcaccccagccagcgatgggttacccagagctactttggggctcttacatctagaatgattggatcatatggagtggtgatgagagtttagtagaaagaggctaaaagtgtatgttgaatatctaaagttgcagggagaaattgtatgtgattagtcagaggcgatgcatttaccccaccaaagatactgcagatgtcagaccatgaatgaggggtggaatctccaaagaatccaagaaagtggccttaagagaaagagtcagttttaaatactgctctgggcaaaggaatcaaggaagacatttcttccttcattaactcttcccctttaaatttcaactctagaggagatagagcagctttgttcaattgtgggagaaaaaggaaggcagaaggagagaaactaggatgaaaaatagagaaataacctagaccttctttctcaaatgtaggctttggacctgatgtagtgggagggaaggagatttggtttacgtaaagtgcaaagtgaactagacatattaatccagaactgcaccttttgggggaactaaaagtgaccagagggtgttttgcttttttttttttcttttgaatgtcaacggaaagtagtgcagcctgtttgagattacagtgtcagtggaatttaaaaaaaatggacctataaaatgaatttgataggcagtggaggaagaactagcttcttttctgatgtcaccacataaatcccatttgttcaaggtacctgcacttactatccttttcaaatgtaaatattccttgggagtacaacagtacattatcgcaacttttgagtatttttcaataatacattatgctcagaaagacaccaggattataatttttccttcctgcaactcttctttcacttcagcatgctgttactagtttttcagcttatatatatattttgccatttaactaacagacaacttcatgaatcatacaatagattttgtttcagaggcatgtcatcagctccacgagactgaaattgataaggacagtcaaagcatttgaatcaaatttgggctcctctataaatgggtatttttaaaggagaattcatcacttatagtaatgctgtaaatcttggtgttaaaatccatgctaaatgggactcattggtagggctgtctaatatctaaattcagtatgaactataatgtcagaaaaatctttgattttgctgtgatatgttgttacatttacatggaaaatttcagaaatttacacattttatatctctcaaaatagttgtttcttgtaagacagaaaacaagtaagtgttcaaagacatgtcccacctttgaaatgaggacagaaaatagaatgtggcttaggggttacttaatacagctactcagaggcagaacaaagacaagacagagctgaaggctgacaacttttcagtgaatttgtctagcagcwggagctaccaattattgaaatttataacatttcaggctctctaagagggactttacataatttatctcatttttttatatgctatgtggatatctaatctttttaggattcagcaaaagaagatttagatatctcctatttgagtcaattctaggaagcctaagagatctaccaagatggccccttggcaatcaccaaagcatcagaaatatttctgttatttgggtttaaaagttagtatcaattccattgttgcagtagcagcttgggtgttccaaaatgtcatccaagtacagtatatgatgtaaatgtttgcaagacaggaaaaaaaataggaaaatgtagactaggaaatgtgttgggggaattgagaagttgaaggacaagaaaatagtatctttattcttccacaaccacattttacaaaccttatcatcattttaactataaatatatttgtatttcagatttttaaaaggctatctttcaaaagtttaccttcttttcctttttgtggacattagacactgtttaaggtccatatgacaatgttcgttgagtaaaataaagtatgcaacagtaatttagaaactcatatctatgtaagtttatttaagtttggccatatggtcagatgcctcctgacactacaaatatctttctgttatttaaaattttctataaaactctagcagtaaatagttggtaatgtgaacatagttcaccaacatttttgtcttacaagttacacatttttgatagtaactgtataattccatctatttttataagaatataacatggtgatctagcgtaacagtatacatttatttgcattttaaaatgaagaagcagtatgtaaatattaggctagtgcaaaagtaattgtgtctttttgccattaaaagcaatttaattttaacataaaagtatattagtaatatactataattatataatataattagtaatataatagaattatataataaaaacccataggaagcattttattttgaagaagaaaccagatagtttatttttcctactcattttctttcttgtatctctgtgggtgcatgagtctttttcttcatttcttagtggcacttatgccatttgtgatttgtatgtgtgtgcctactctttatgctgtaaatcttggtgttaaaatccatcctagatgggacccattggttggtctgtctaatatctaaattcaatatgaactataatgtcatgtcaaaaaatctttgattttgctatattttgttccatttacatgaaaaaataagttcttcatatggatacataagagtgcagaggttagactgtattttgagtttctggtttccagttgggacattgatcatttgttaacttaagatcttagcttgtgaataagtcttatctgcattggataagacttaataagtcttatctgcatctggatcttagcttgttaataagtcttatctgcataacattttgaccatatttgtgggtatttctacagactaagttaagttttaaatatatatttctaagaaaagtgagaaagaaaaacgtgtaggcagtaataacataagctttgcagaggctaatttccagatacaaacatatagtacaatgtacctgtaataattataactatttttgacaagtaaattgatatcttgttgccttcctttattatagatgaaaaaacagtttacctcagattactggtcacagtgaycctaactcatatttggttgtaaggtagtacattacccattttaggttattcagctcctaaactcgcaaatattgacagggcaacatgtaccacagatgtgtgagattttaaagctattgaagaggytcagtacattgtgtcttaaaaatagtcacatttaagcatccattggattgctgtattatggtatttacaatgatgaggtacaaaagggtctaggtctatgtttgcatatactctggaagacaaatcctacatttgcagcattttaccagttgcagctattagaatctcctaaatatcttaacctgtgggcttacatattttcttatttttttttcagaagtcttagaatcaagaaagggccatatatgaaagtagtgaagtggcataatattttttaatatttcatgctttggtcaatgccacagtaccctagaattttagtaatgattacagttaaaaattagtgttgtattgctagatgtattagtcyattttcatactgctataaagaaatacccaagactgggcaatttataaataaagagagatttaagggactcatagttccacatggctggggaggcctcacaatcatggcagaagaaggaggagcaaaggacatcttacatggtggcaggcaagagaaaagtacaaaggaactgccctttatacaatcatcagatcttgtgaaatgtcactatcacaagaacggcatgggaaaaaccgcccccatgattcaattacctcccactgggtcccttccatgacacatggggattatgggagctacaattcaaaatgagatttgggtggagacacagccaaatcatatcattctgcccctggtccctcccaaatcttatgtcctcacatttcaaaacacaatgtgcccttccaacagtcccccaaagtcttaactcatttcagcattaactcaaaagtccaagtccaaagtcttatcagagataaggcaaatcccttttgtctatgagcctgcaaaatcaaaascaagttacttcctagatacaataggggtacagacattgggtaaatatacccattccaaatgggagaaattggccaaaacaaaggggctacaggcccaacataartctaaaatccaatgggcagtcattaaaccttaacattccaaaatgatctcctttgactccatgtctcacatacaggtcgtgctgatgcaagaggtgggcttccatggccttgggcatcttcacctctgtggttttgtaggatacagtgctctttctggctgattttatgggctggtgttgcgtgtctgtggcttttccaggtgcacggtgcaagctgtcggtggatctaccattctggggtctggaggacagtggccctcttctcacagctccactaggcagtatyccattggggactctgtgggggcgctccaacccygcatgtcccttctgcactgcgctagcaggggtccatgagggccctgcccttacaacaaacctctgcctggacatccaggtgtttccacacatcttctgaaatctaggtggagsttcccaaacctcaattcttgacttctgtgccccgtagggtcaataccatrcggaagctgccaaggcttggagtttgcatcctctgaagccaagcttgagctgtaccttggccccttttagccatgattggagtgcctgggatgtagggcaycaagttccaagggtgtacacagcaggagggccctggacctggcccaggaaatcatttttcctccctaggcctcagggcctgggatgggaggggctgctgtgaaggtctctgacatgtcctggagacattttctccatcatcttggtgattagcatttggcttcttgttacttacgcaaatttctgcagctggcttgaatttgtccccagaaaatgggtttttcttttctactgcaatgtcaggctgcaagttttccaaacttttatgctctgtcatctcttgaatgctttgctgcttagaaattttttccaccagawaccctaaatcatctctctcaagttcaaaattctctagggcmggggcaaaaagccagcagtctctttgctaaagcatagcaagagtcacctttgctctagttcccaagaagttcctcatctccatctgagaccacctcagcctggacttcattgtccatatcactatcggtgttttgatcaaagccattcaacaagtctctaggaagttccaaactttccaacattttcctgtctccaaagccctgcaagtctctaggaagttccaaacattctcacattttcctgtcttctcttcaacccatcaaactattccaacctctgcttgttacccagttccaaagttgcttccacatttttaggtatatttacagcagtgccccactaatcccggtaccaatttactgctttagtccattttcatactgctgtgaagaaatacctgagactgggtaatttataaagaaaaagagatttaatggactcacagttccacatggctgggggggccacacaatcatggcagaaggtgaaggagaagcaaacacacgtcttacatggcaaaaggcaagagagaagtgcagggtaattgccctttataaaaccatcagatctcgtgagacttattcactatcatgagaacagtgtgggaataacccacctccatgattcaattacctcccacctggcccctcccgcaatatgtgggggttatgggagygacaattcaagatgagattttggtggggacacagccaaaccatatcactagggattgttatatgctaagggctttttatacattatttcatcctcatatctttgcaaggcagatattgtttttttaatatataaataagaaaactgaagcaaaaataagccaagaaatgtattcaaagttttaaaaaagtatcctaacaaaggtctgcctgattccaaaaatcctgtctttcccattgcaccaatgaccctactatagtatctttcagtatcctattgactttttgctctttggcatcacagcaggacattctttacattttaaattttacttcaatatgaaagttgaaaacacttagacaatatctcttggcatagccagataataatcataaacttgaaatcaaataaagctctgaaaactgagtttgaatatctgggtactccaagggcttggttctggttcatatcctcttttattttccagtggcttttctgcaggaggggttctggaaaaatatggtttctaagcacctcgtaaggatcaaatactgttttcagaaggctgatgaagcttcagaaaaacaaatctgtttctgttgtcttgctcctttccctgtcttgtcatgccagcctcctctacccatcctccaggttaacatattaggatttcaaaaccagagtggaatagatgctttaaatccttatcacacccagctgtgtgaagaaaagtgattgcaaatgtatatgggtctcaaagcccaaccagagacattgtacggtaataggactccttcatgcccttctcttttgctctttttccgttttgctttcctcacagtttacccctaccagtcctctaccaatgttcttgcttaaggtgcctatcctgttctcttagagctttgctcttaaccagctgttagctaacttcaactgttagttgatattgatgagagtttttatttcaagaaggatttgtcttttaatgagagattcttcaactgaaaagcacttatgcacaagaatgaatttcaaattatagaaggttatggagtaaattctggacagagtttctgctcaagatctgttgcttgatcaggttatttgtatttacaaagtggaggcatggagtcaatacaaagaagtgagtgatcagaaaccagaagagagttttataacagttatagctgtatgtgggaccacagcctcctagctttcacgtaaacttatactaaattttcagcatttcaattgcagaggtttcatatttatatatttatatgataatcagggcattatgtccatgaaggtaaaaaagagtttttaaaaaaaatctggccgggcgaagtggttcacgcctgtaatcccagcactttgggaggccgagacggacggatgacgaggtcaggagatcgagaccatcctggctaacaaggtgaaaccccgtctctactaaaaatacaaaaaattagctcggcatggtggcgggagcctgtagtcccagctactcgggaagccgaggctggagaatggcgtgaacctggaaggcggagcttgaagtgagccgagatcgcgccaccgctctccagcctgagtgacagaacgagactccgactcaaaaaaaaaaaaaagaaaaaaaaactaagtggacatatttttttgatatatttaatttttctttttataatgcctttccatgatttcaagttttaaaaagtttattaatgcagtttgttatctatgtggtaagatttctaactacttaaattatacctttttagtattttagattttcttcctgctattctaatctacttacaaccctgataaacttaccagatatgctgtttctatattgtctgtgatatccttttaagggtttgtgtgccacttcctactgatgataacctttgttctaaataccataaggaatgttcccacagagaagtggtggattttcagagccagtatctttatggttctttaagcatttcgtaattctagatgtggttgtgcggtacaagtttctttgtgtcattttgttattggagcagggaaggtatctacttatgcaaatctcatttaggatttgggtagattaatttcattattctattttcctttttgttcatctttgaagctttctctgcattgttttgtacccgcttttgtgactgacttttttttcttctctgtctcttttaaaattcttaataaaatgaatttagaaagtacccactgtaataccatactgttctttggtttgtgtagttatcattgttaattcagttatcactgattggacattaaaaatataccagatactttgcatattttatttctaatcttcaagaaaactattcaagatagatattactatccgttttacaaagggagtataagatgccacactctatcaacttaatcacactgtattaaattataaatttatattaaaataatttgttttttcattattcctagagtaaatgtattcaaccaatatgtattgtgcatctgttataggcacataatgggcttaaatgttgtggggattacagagatgactcatacatccttcacctcagttagtttacaggctggatggggaaataacacttgagcatacataaccaaaaaataaggtagaaccygtgaacttcttctaggtggtctcaaaatcccaaccactaatatcatatcaaatataaaaataagctcactaaacatgttcagtgactgagggaatgtctatgtaaattcaggacctgtatttacatagactcttatctgtgtgagactcttatctatgtatgacggaaagaatcatgataggctccatggacagtgtggtctttgagcagaaccagggtacagtgtagatcccagaggtgaggaaaggatatttcaaggcagcaagttgtataaagcaagaacgtggaggcaggtgagtgtggggtatgggatggttaatgcacaagggaagcagtaatgaggcagatgaaaatatagaccaaaattccatggggaggacgttaagggaccagctataggatgtgggtctacttagtcggcaaaggttttattgaaccatagaagaaaatgttctyagttgtatacggaacaaagaaaataggacaatcccatttggattttggaagaaaaaaaagatgtgctaccagcaatctttcagtgttggaaatatttartaagtgtattgaattttttttaactttcttccagttaaaaccttaaaaaacaaaataaaacaaagcaaaagtatctcataatgggtagggtaaagattgttattctcaatatcagacaaagtgaataactattttagtcccattcttcttttgcctgacctgtgtgtccagtttcaagacagactgatttggcatggtctgacatttaataaaacacagtgcaaagtgggagtaaaagaaaaatatttttatttggacatgatgtagagaaattgtctgcacttcagagtcaatatacctgagtttcaatcctgaatccatcctgactatgtgatcttagataagtcagctcattttctttctttcttttttcgtttcttttctttctttttttttttttttttgagacggagtttcttctgtcgcccaggctggagtgtagtggcatgatcttggctcactgcaacctctgcctcccaggttcaagcgactctcccgtctcagcctcccaagtatctgggattagagacttccaccatcattcccggctaatttttgtatttttgtagagacggggtttcaccatgttgtccaggcttgtcttgaactcctgaccttgtgatccgcccacctcggcctcccaaagtgctgggattacaggtgtgaaccaccgcatcagccattttctttcttaaaaatttattatcatttctttatttcaatagcttttggggtacaagtggtttttggttacaccgatgaattatatagtggtgaattttaacattttagtgtacctgtcacccaagaagcgtacattatatctgactgatggttctttattcctggccccctctcaccctcccscttctgaatctctaaagtccattatatcactctgtgtgcctttgcataactgatagcttagctcccccttgtaagtgagaacatacagtttttggttttccactcttgttgttacttcgcttagaataatggtctccagctccatccaagttgctgcaaaagacattatttcattccttttaatggctgagtagtatcccatagtgggtaaataccatattttctttatccactcattagttgatgggcacttaggttggcttcacacctttgcaactgtkaattgtactgctataaacatatgtgtgcaagtgtgtttttcatataatcactgctcttcctttggttagatactcaatactgggattactgtatcaaattgtagatgtacttttakctctttaaggaatctccatattcttttccagagaggttgtactaatttacattctcactagcattgtgtaagcatttctttttccccacatttacacgaatatctattgtttttctacttttttcttttttttctttttgagacggagtctcgctctgtagccaggctggagtgcagtggcatgatcttggctcactgcaacctctgcctcccgggttcaagtgattctctttcctcagcctcccaagtagctgggactacaggcacatgccaccatgcccggctaattttttgtattttagtagagatgggatttcaccatgttggccggaatggtctccatctcctgacctcatgatctgcctgcctcagcctcccaaagtgccgggattacagctgtgagccaccacgcccagcctgttttttgactttttaataatggacattcttgcaggagtaaggtggtatctcactgtggttttgatttgcatttccctgatgattagtgatgttgcgcatttttttcatgtttgttggccatttgtatatctttttttaagtaaatgtctattcatgtcctttgcccacttttcaatgggattatttatttttttcttgctgatttgttcgagttccttttagattctggatactagttctttatcggatgggtagtttgcaaatattttctccgattctgtgggttgtctgtttactctgtttattatttctcctgctgtgcagaagctttttagtttaattacatcccatttatttatttttgtttttgttgcatttatttttgggatcatataccagttaaactctgtcattttttctcatagtgtacatacttaagcccactcacccaacttctgagatcttatctggaagctgccgatcatcagttttaggtgttttctacctattgggagtctacctttctctggtgctggctacgaccagttattattttagagagacaatttaacaatcacctgaccatcagctgatagtcgcctgataattcttggtcgggggctggggcagtgggggcatgggggtgtgggttgggttggggggccctctcttccctgctcatggttgcctagctacccattctagcacttggaagcctaactcactcaggttactcaagggtacctatgatttcatgtacctagacacaatgagaaaggttaagataaacgtagtcaccaaaattttactgttggtacctccaattacaataatttagttattctcattatttttttcccaaagtagttgtgagaaaccagagaatacactcagtaagctccctggcagtaatgtattctcagtctttatgtatttgattccttactgagctgcaaataccaacctaactaaggaaataatgctgaatttgtttaaatgtttcactttcgtaagaaattgaatgaataaacttcagaataaaatcttcgattaatatctgctgtatccatataataacctttgtgttatagartcactctaactatgttttaatctctagcaccagaggttgttgggttactattcataattcttcttgtttaattcctgggaattgtatgctaccataggcaatgtccttgaacatgatatgcactcattaaaattttgttaacactagaaagagagatgggggaattgaaataaattataatgttaartaacaaatccatatatgtaatatttataaacctaaatataatgttgatattataacttgacatattataaattacatattttgttatacctatttatatcatatataggtgtgatatgcaataaaactgtagactattgtgggaaatttttcaaataagtttgagagattataatttaattgtaccttattcaatttgaaatattgggtttgaggccactttgaaagaaggaccaacaattgagcatcacaaatataaatttgtatattcacctatttatttcaatatgtaattcatgacatagaatttattataaatatatttccctgcctctatacactcactaccgctaccacttaccaccaccaacgaaagcctctacaatttggtaacctaaggcacacttcataaagggaaattttaacttagaaatgtaagtcaatgagtcaaatttccacttagattgaaatgcttattttttctatttttttaaaagtacaagttgagtgtctttagaaatggcataacgcagcatgatggcagtttatctgaattaatgctacttccaaagctacctaactcaaagtcagggaaaagcagatattcataagaatctgactsaaagcaaagcatttcatcttctgtccaacattgcagctgctatcaaaaaaagtgtatcatatacataacctctgccagaaatgtctaatttgttaaacaaaagaaataattcttatacagcaaagagtttccagaagtctgtggtcttttaattgaagacacgattaatagaacacaagttgtttcgcaataccctgcataagaatatgactgaggtttgckgaaagccacttaaacaaaataaatgacatatacatttaatagaagctcactgctgctaacacacaatgaaaccctcatggatacaaagcagttttatacttttaaatwgcctcttagtaccagcaagcacaacraacaatagactttaaaaaatattttgaccgagtcaggagcaggattttatttmtttgtttttaaaacagcattctgtcatttcagaaatayactgcaaaaaggaattgcttaacaggggtattgacaattactaatttgcttatcaggggtacttacaattactaattttctttcttttttttgagacgagtctcactctgccacccaggctggagtgcagtggtgcaatctcggctcactgcaacctccgcctcctgggtttaagcgattctcctgccttagcctcctgagtagctgggattacaggcacatgtcaccacccccggctaatttytgtattttyagtagagacagggtttcaccatgttggtcaggctggtctcgaactcctgaccttgtgatctgcctgcctcggcctcccaaagtgctgggattacaggcaagagccaccgcgcctggtccaattactgattttctcatgtcaagaataacttcattattagctgtttacaatttaccaaggttcaaactacctttttctccttcgttcttaaacctgtgccactgagatataggtcccaaaatgacgttcttatgttttaaaatacaaatctatagcaaaaacatttcattttaaaagatactatctttttattatgggaccttagttagtactacatataaaacaatcttttgagaaggtatatgtcctagcaacaaacatcagacacacagaccatatattcacactgragatgaaaagggcactgttaaattatacaggaaatcactagaacataaaacaataactatagagttacattgtcctctaaaggggcaagtaattcagtggctctctctttaaaacctctactgcattcctcttgccatatgtattggatcccacgttggtagatgagagaatggcaccaaagttgttgcyggaatgaactaaaaaatttgccaggcgctgcgttgcacatgtggcagtgttgcatttccgcttttccacctgatgactggtaacatggaacaaatgtgaaaagttagagccttagaattttagctggatccagccatgtgacatcaaatatcttgtattgatgaaaaccaaagaaacaattttcacataagtaactcagtgttttggtttgcaaacacctagatggctgagatttttttttgacaccttgaaataacaattgaaaatcatacaacatctttcattacagtcaatgttgcatttctcagttaaaagtcttcctttggaaattcagaatatattacatataatcaaaataacagtgtctttgtcttacatttttaaaaatcttgaagaatttatttttaatatataaaaagaatttagaaggtaaaatttatatgtaatctgaaatatgaagaaatttaaaaataattatttctacatctttccaataagaataaagcagcattacttagtctttaagttccttgagataattgaatcaggagtgttatgcaagaaatgtcataagggaattctgcaatatgcaacacacggatgaaccttgaggacattaggttgagtgaaagaagctagtcatagaaagataaataccacttggttccatgtatatgaagtatttaaaatagtcaaattcatgagttaaagagtggaatggtggttatcaggggcaagggagagggggaaatagggagttactaaccattgggtgtacagcttcagtcaagcaagatgactaagctctagagatctgctgcccaacattttgcacataatccagaataatgtattgcatgcttaaaaatttgttaaaagggtagatatcatgctttgttcttaaaacaataaaatgaaatataataaagtaaaaaataatgtcataaaaagtatgtcaaaaaaagagaatatcataaagtctccaaaagaatcaaatctatcacctgttcaggtactctattgcagtgtgagagttttattacttttagcataaatacattttcctgcttggatcttatgctttcaagaattttaatgataagactaggttaaatgttaaaaccaaaagactttttatgtcaatggtattaatattcatcacatttttctagccacctggaagaagtgcataataatacttataaactcagaaatcataaccacacattaaataattcatttaattttaacttatgtttttatttaagacatttatttgtataccaactctatttttttgacagccttttgtttcaatgtgcttttaaaacgatatcggaaatggatgcagaataataacattgsttcctctttgctgattattaggaaagttagagaaatgttttagttttcagctccatagaaatcaaaatattggtgaaacttagggtaaatggaaaatgaaatagttatagggctaaaaactcaatgtccaggagccagtggatatgcataatctgggactcaaatgcaatggatttatctcattgtgtttacctkgtgtggggagtatttcattatctctatctctaagtagagatagcctaagagtaaatatttaataatctcatgtgaaactgttttttttttaaattttactcccatatttcttcctaagtacagaaaacttcttacagcattaggtgaactggatacttgttgaatgtaagtgtatgctgacaaatgtttgaacaaattatctgggcaaagaaaaccactttgggatctaattatttaacctatatcaatctcattcacactatctgttcaattatttatttttgaaggtaccataaatatgaccaatgtacatttcaaaagagtgatttatgctttaaggattgaactagtaatttcatacatttgcattgaattctaaaatacttacttttcttgaaaaacagtaaaaattggaatttggtccaaacatctcaaaaaaagtaataaaggaaaattatgggtcaaattgagaagrttcaaaggtaatatctgttccaagatatgtttagcatatgactgaagcacagtgtgaaatamtttatatgctaaatgctgagtggtattttgataattggttggaaggtcaataatataatttaaaattgttctaaataaaatgttaccttatttgagttagctagatgggccatcattccacttagaagaaatagtaaaagcatttatgtttttatcatatttgtgaaattgcttttctaaaaaagacttttcatctaaatatactattcagtatatataagattctatctaaagcaatctttaggatggaaaaagttgtctgaaatggttaataaaaggcattacctccctggtttcaggcatttttttctcattgactacctggacaggtaacatacgagctagtaacaaacattaaagctgtagaccacttacaggcacatacacacatggaaattcttgactttaagagagtttaaacagagatgacaataagccaaagtataactcttaaattgcctctcttttaaattgtctctccagagttttcaaaatgactttaaagtgagtccctgctctcagccttaacattcatctgtggaagtatgtgagctcctgcagggagatcctagtgattgcatcttggcatctatgtaattatatttttaactatcctttgattacctgccaggcagatatttacaagggagtgtaaaaaagttggtgggaaagtatgtgatccttttatcctatttcatacatttacaaattgaaaaaatctcaaatgagatgattaaattttgtgaggaaaatgacattgaataatgttagttttattttttaaaaagagtttaaaatttgacacattttccccatagattttcctagctttctgtgagatatgtagaatagtacatgatttaacatctcagcatgacaaatcatactccctttaacaaatgttcaaacatactcatttcaggcaacatattaaaaagcaatttgaagaatgttttacaagatttctaataattcaaagttaaagattgtgagactaacatcaaaataattttataacaagtaatattatattacatattgctctatttctaagtgaagtttctctcataataaacaaacatctataaaaacataatggtctgggttcagtggctcactcttataatcccagaattttggaagactgaggcaggaggaaggcttgagcccaggagtttgacaccagcctgggcawcatagggagaccctttccctataaaataaagataaaacaattagctgggtatggtggcaggtgcctgtggtcccagctacttgggaggctgaggtgggaggatcacctgagcctagaatgtcaaggctacagtgagccatgattgtaccactgtgctccagcagcctgggtgacagagacagagagagagagagagagagaccctgtctcaaaataaaataaaaaaaagagagggtaaaagtgcttagtaaatttctatatctattgaaagaaagtatcaagatataaacagatatactaggaaatactactgattttcctgtcatcattcagatattctgcttatcagaaacttcatgtcattttaaaagttatttttatgaaaaagcaaatagaaaattacagtcagttctgagaagaacaccctgtaaactaaataagccttgaaatgacaaaaagcctctgataatgattcttgctatttattatacgtaggtgctgtagaaatctttgcatattgctatgggcttccaagaaaaactacctcgaaggaaaacaaagacaagatgacgatcattctaatgagaagaattataatatgacatgcacactctttacaaaggtaaacttaattctccttggtgttaaagagtgtgtaagttcagtcccataagactatatggagcaaaactaatttaggcacaaacaaatcctcactatgttatttatgacttatgcacatatttgaacttaataaccctttaaataaattacagttttaaaatctcagtttgaaaattttaactactctaagagttttacgtgacatagttgttagatgtccttaattaccatttaaatgacatgaaacctttcgtaataagacttcccaggaaatcctgacatacatgctacctactgaaagtaattttaaaaagtattaagtttatagcagcttagaagtaataagaagaataactttttataaatctgtttcactcacagaatagctagctagcaatatagaataaatcccccaacagcaaatggctttttaactacttcttttagrtttcatttcttaaaaacattaatttgctcctgattatttctatacatttccatttccacaagatgtaaaagtttttaacatttccagagacatctgaggaaaacaaaaatctaagtaatatatacaaaaagaatccacttggtataaaaatatatgctttagttaagtttctctggtttgtttcagtatcaggttaatatagaagaaattactaccttttgatttttttccygcttcatgttctggctttgcccctctaagttccaagagtatatttcttgacaaaactggaattatccattcctgtctgtcagaagttccatcaaagatatttatttgccactggtgttattctttaaagaacacagaattcaaggaacaatggaatagctgaaggtactgttcttaagyatgatatagtcagaaatctaaggctgtagttatttgacagtatttaattctaattttctcacactttacaaaagttacaaagaaacaggattttaaagttaccaacctttcaatgggtgtagctttcagatggttcaatgcaacagagagcacaatgagaaatacttgcagcttcaggatgcccattgcttctcaaattttctgcaaagaataatccagcactgaaatcaagagatttcttacagttctaattgaygtaattttaaattagagcttagtttttaaaagaaacatctttttaaaacgtaatttacaaggatcaaaattkttattgatacagtcccttaatattgtccacttttcaagtaatttcgagatttttactttcccaatttccttctctaagcaatctgaacatttatattgtaatacattctccctttagcctttctttgaaataaaccatgaatttaacaccaagtgtgcrtttctctaaataaataaaactttcccagaaataggaaattctttaccttttaatgtttcaatgtcagcaatatcagcaaatgcttctgatagaaagaaagcttcaagaaaagagtccaagcttgtatccactggaatatttaccccctcatttgctaactagtaatccagctcttatatacccctcacacctttctcagctctgacatcaggcagctcagagagcctctgtcattaatttccatccctatagatagaaagtacctcacaggcagcagaagyggatgggtcattattacattaactcatcagtaaatattaacgtagcaaatacacagtgtccttgtgcagttaatggtgtgtcatacacagcagaagtktgaatttgccatctttgtaagacatgagtgaatttccaagaattaagtgtatgttatggtaaggaactgatagaaaagggtaaggataacaacaaatgtgcatatatgcaaacagagaaatcacagacttttggtatatctaaacccaagtgacctcaatggctgaatcccatgaagcttcaggaataaatggagatataagggaaaggtgtataaaaagggcataaaagagaaatcaaaagtcatttacaatgaggtgaggggagatttaaaagcataagagtaatggaagacctactctgtggtagggattattctaggtaccagagatatgacagggaacaaaacaaaattagaatgaacaaatgctacataaccaaatgaataaaaaaattcatttttcagcacttagatagagatccataggtatatgtagtcaagtagtttttggatgaccttttccattcattcttacacagaaattttacaattattttgaaagaacagatttgtttcccattagctccatgagaacattatgaatggcttagctcacacagtactttgtagtttgtcttttaaaatgatttgctttttaaaattttctccaaattgctttttctttttcttgtatttctttctctctttctttttttttctttttttttgagatgaagtttcactctttgttgcccaggctggagtacaagggtgcgatctcggctcactgtaacctgtgcctcccgggttcaagtgattctcctgcctcagcctacagagtagctgggattacaggcatgcatcaccatgtatggctaattttgtatttttagtggagacggggattctctatgttggtcaggctggtctcgaactcccaacctcaggtgatccgcccacttctgcctcccaaagtgctgggattacaggcgtcagccaccgcacccatcctctttttttgtatttctaaattatatttggtatcttagttattaatagaacaacttagtgtcatgtaaagcaaataaatttcaattgtcagtgaaaatgtgcatgcctgtgtaatcttaaaaaaattgaagttctctaactagaaacattagttcattgatttcatatacttcttaaaagctttgtaacattgtttgaaggtgtttggtagagatttcaggaggaaagaaacttgtttagaatccttgttctaattattcaatgattctacaattttaatatttctgtgaaatttactgatattccaaaagaaaaaaaatcaaaagaaatggaaggataatgcatttccgtaagaagataatgtacttaacaaggtgaatatgaggtaggaggcaggactagactccagaggcagggcttgaacaccagaccaaattgagaactagctaaaacagggccaatggaaagcagctttccataagacacgccccctagtgtgccatgtcagtttaccattgctataacaacacccaggagttactgcctctttccagggcaatgaccagatgacccaaaarttactaccacttcccttgaaatttccgcataaaccatcccttaatctgcatgtagttaaaagtgggtataaatatgactgcaaaaccgccgtaagctgctactctctgcatatgggttagccctgccctgcaggagcagtcacagagttataaatgccagagctgtaacaccgcctcttcaataaagctgttttcttctacctccaacttgcccctgaactctttcatgaacaaagccaagaacccttgagggctaagccccagtttgggtctcacctgttctgcgttaaatacagtgatgtagaaagcataccagggccagtgacattaaataaagttcaacatcaaacatctagttaatgctgaatcctggaccaaagcttagctttatgactcatggtctagtgttcatttagacaaaaatacttgcttattacctacattgttatttrttctattttcataaccttttttgtttctctaagatgttaagggtgccaaacataacattcaaaatggatcctctcttaccctaatgttataaggaaaatcttctrtcgaaacactgcacgttctcactcataggtgggaattgaacaatgagaacacatggacacaggaaggggaacatcacacaccagggcctgttgtggggtcgggggaggggggagggatagcattaggagatatacctaatgttaaatgacgagttgatgggtgcagcacaccaacatggcacatgtatatatatgtaacaaacctgcacgttatgcacatgtaccctaaaacttaaagtataataaaaaaaaaagaaaaggaagacctggtattttataaggactatcatatgtcaggcacagtcataaaattgatatgcgatatcccacttcatctttgcacctcttcggtggttattatttgccctaatttatagataatgaaaatgagattcaaagaatataagtgacttgcttaaggttacagagctactcaggagcagaatgaaagacaaattcttatctgtctgatccaggatatttgtttttttgttaaaaatgatctatattttcatattctaaattgctaattgctttctctaagttgtatatcttgttacaacaccttgaatgattttgttatagccagatgtgaccttatgctggtctgtctcgtataatgtttagtaaaatcaacatctatcccaatctcaaatagcttcagagtttacatgctccctgtagcactaatgaaagtgaaggtatgtggatatttagattatctttacaagggcataatctcctttctaaaggacaagcatcactgtcacttatcttggtatcccctctagccttgctaagtcaaagtgtgaatgaggtgctggcagcttttgcatcacctgggagcttattagaaatgcagaatctcaggccccaccttggatccactctatcaaaatctgcatttcaaaaatgatctttccttagcaattgcatacacactacagttggagaaaaactgtcccrcaactttaaaacatcagtctggatgtggaataatatgtgatatctcacttcatcttcacacctctacggtggttatcatctgctctaatttatagatagtgaaactgagattcaaagaacataagtgacttgcttaaggtgaaagagctattaagtgcagagtgaaagacaaattctcatctgcctgtcccaggatatttgtggaatgaattagagggtggcaagagtaaaaacaggaaatctattagcagacgatgtcagtgagatcatgaggccttagaccagggtggttgctgaggagttagagaagtaaatgactccaagtcatattcataatcataacatgctttgacaatgacatgaataaagggaagaaatgagaagagattgaagataaacatgagtgtcaggatataattcataatatgtattaatcttcttcctatcacattttaaaagtaaaagatgttttatatatcattttaaaaataatttttacattttatcaaatttgtatgtgttcaaatggtattagaagactaataataaacacagtagttccttgccttaattctgcccacccataaattttgctctccacacagttttaactattttaggtgtttctacatttctttattttagctgtttctacatttcaaaaatatttacttctctggacactcttgatttattaaatttacattttatatgttgatatcccatattagaagaagaagattcagctctcctcacttttcttctctatcactatcgtaaaatagtttaataaattttttgaattatatcaatattaggtgtacatcttttttctatttacattttaaagtgtttcttttgggaactttcaaatgtatataaaattagaacaattatcaacaaatgatctatcttgctcactctatattcctacctactttcctcccacctcccactgtattatttaaaacaaatcctagagatcacataattttaactgtacattttttagtgctataaaagataaggacattttatagaacatagctctgaaaccattatcccatctaaacatacaatttatgggaattccttaatataaatattcattcagcattcacgttttccagttgtctacaaaaaaaaaatttaactggtttgttggattcaggatctaaacaagattgcatttggttgctctgtgtgactckttaatttacaattttctgtccgttatttttcacattactgatatttaaaaaatgggggcatttgttgtgtagaatttcccacatcctggattttgctgatggcatacgtgtggtatcatttaacacgttcctttctcatttgcatttcctctatacttgtagtttggtctagaggcttgatatgattcggcttccattattttggtaagaatatgtctcacgtgatgctgtttatttcctattgcattatatcaaggggtacataatatcttttatgaggttaaaaatgatcagtgggttcagatagcaggcaagttgttcattctgagttctctatcagcctttcatttactggttttagcaatctttgctgataattgcctgaaatcctttttattaggggttgaaaaatagtgctagtctaattctgtcattcatttgtcatttattagttgaaattcttcaatgaaagagaacatctcttgttaactatttgattaccttgaggtagttttaaatgaaaggcaagatatatgatttttctttttcatttttttgaaatatactttatatgtattttgatttcctttgtctttttcatattaaaattatcccatgttggatcaacaggaatcccttccagttgccttctatgtcttgtagtctcggtactttgatagctttattaatttctgatgaatggcgtgattttataacaacctaaatgctgattactattgaactgagtaatatgctgtgagtattttccttttttatttaaccttttgtttttcttctaattaacatttgcctctttttcgattgttcagttttaggcttgcaaattgtctcagagaatgataaaatatgatatgaccactcttcatatgataatatttccttcttatttccaacttcccctctcactgcccattctcatggaaatctttctcctatagcctctgaccttctgcttttctccaaactgaytgctttctaggattgctacgtagttgtttttatccttttgctttcatattgagaaatactcccatcattcttccattttaaaaatactgttctagttttcttgatttaygtccttattttgatggaacatatactgcagtagcttcctgagaatggacacatgaamgactgagaccttttgtttctgagcatagttctaaacacattatttttattcagaattataaaggcattatttcattgtattctaaccrctaatgtggctaaaagaaaagcagtttttgattttttatatttcattgtttaaaacctctctgtagaagtccttaggatcttttctgtattcctgatatatttaaattcaggctgatatgctttggtgtggatctttttctattgactgagctggaaactcagtgtatcttttaatatataaatttgtgttatttagttctgaaaagtacttttgaattttttcttgatatttgtctcctctccattttctctgctttcctctcccaaaacgcttttattaatcttgtgtttatatatattttcactatttttaatctctttaattatttaacttctatgaartttcctaatctaccaacttttccataaaaaaacaacttctacaatcatatttttaattttcaagagatcktgctttctgaatcttcttttatagcatcctgcttttgtttcattgatgtaatatccatcsttatctctgaggatgctatttacagctttctcttttctggtttcttttcaaaattctccttctgttgtggtcttcatttccttcagatcccttttgttaaaaaatatcttttaatgtttatatttcttttttatttttattttattattttacttaaggttctaggktacatgtgcacaatgtgcaggtttgttacataggaatacgtgcgccatgttgktgtgctgcaccygtcaactcgtcatttacattaggtatatctcctaatgctatccctcccccgcccaccccccggcaggcccgtgtgtgtgatgttccccaccctgtgtccctgtgttctcattgttcaattctcacctatgagtgagaacatgtggtgtttggttttttgtccttgtgatactttgctcagaatgatggtttccagcttcctccatgtctctataaaggatatgaactcatccttttttatggctgcataatgttccatggtgtatatgtgccacattttcttaatccagtctatcactgatggacatttgggttggttccaagtctttgctgttgtgaatagtgctgcaataaacatacgtatgcatgtgtctttatagcagcatgatttatactcctttgggtatatgcccagtaatgggatggctgggtcaaatggtatttctagttcaagatacttgaggaattgccccactgtcttccacaatggttgaactactttacagtcccaccaacagtgtaaaagtgttcctatttctccacatcctctccagcacctgttgtttmctgactttttaatgattgccagtctaactggcatgagatggtatctcattgtggttttgatktgcatttctctgatggccagtgatgatgagcattttttcatgtgtctgttggctgcataaatgtcttcttttgagaagtgtctgttcatatccttcacccactttttaatggggttgtttgttttttttcttgtaaatttgtttaagttctttgtagattctggatattagccctttgtcagatgggtagattgtaaaaattttctcccattctgtaggttgcctgttcactctgatggtagtttcttttgatgtgcagaagctctttagttcaattagttcccatttgtcaattttggcttttgttgccattgcttttggtgttttagtcataaagtccttgccaatgcctatgtcctgaatggtatggcctaggttttcttctagggtttttatggttttaggtataacatttaagtctttaatcccacttgaactgatttttgtataaggtgtaaggaagggatccagtttcagctttctacatatggctagccagttttcccagcaccrtttattaaatagggaatcctttccccatttcttgtttttgtcaggtttgtcaaagatcagatggttgtagatgtgtggtattatttctgagggctctattctgttccattggtctatatctctgttttggtaccagtaccatgctgttttggttactgtagccttgtagtatagtttgaagtcaggtagtgtgatgcctccagctttgttcttttggcttaggatcgtattggcaatgagagctcttttttggttccatatgaactttaaagtagttttttccaattctgtgaagaaagtcattggtagcttgatggggatggcattgaatctataaattacctcaggcagtatggccattttcacaacattgattcttcctatccacgagcatraaatgttcttccatttstttgtgtcctgttttattttgctgagcagtggtttgtagttctccttgaagaggtmcttcacatcccttgtaagttggattcctaggtattttattctctttgaagcaactgtgaatggagttcactcatgatttgtctctccgtttgtctgttattggtgtataggaatgcttgtgaattttgcacactgagtttgtatcctgagattttgctgaagttgcttatcagcttaaggagattttgggctgagatgttggggttttctaaatatacaatcatgtcctctgcaacaggracaatttgacttcctcttttcctaattgaataccctttatttctttctcttccctgattgccctggccagaacttccaacactmtgttgaataggagtggtgagagagggcatccctatcttgtgcccattttcaaagggaatgcttccagtttttgcccattcagtatgatattgsctgtgggtttgtcataaatagatcatattattttgagatacatmccatcaatacctagtttattgagagttttcagcatgaagagctgttaaattttgtcaaaggccttttcttcatctattgagataatcatgtggtttttgtctttggttctgtttatatgatggattatgtttattgatttgcatatgttgaaccagccttgcatcccagggatgaagccaacttgatcatggtggataagctttttgatgtgttgctggattcggtttgccagtattttattgaggatttttgcatcgatgttcatcagggatattggtctaaaattctctttttttgttgtgtytctgccaggctttggtatcaggatgatgctggcctcataaaatgactgagggaggattccctctttttctattgattggaatagtttcagaaggaatggtaccagctcctctttttacctctggtagaattcggctgtgaatccatctggtcctggactttttttggttggtaggctattaattattgcctcaatttcagaacctgttattggtctattcagggattcagcttcttcctggtttagtcttaggagggtgtataagtccaggaatttatccatttcttctagattttctagctgatttgcacagaggtgtttatagtattctctgatagtagtttgtatttctgtgggatcgatggtgatatcccctttatcattttttattgcttctgtttgacacttctctcttttcttctttattagtcttgctagcagtctatcaattttgttcatcttttccaaaaaccagctcctggcttaatttattttttgaagggtttttttgtgtctctatctacttcagttctgctctgatcttagttatttcttgccttctgctagcttttgaatgtgtttgctcttgcttctgtagttcttttaattgtgatgttagggtgtcaatttaagatctctcctgctttgtcttgtgggcatttagtgctataaatttccctctacatactgctttaaatgtgtcccagagattctggtatgttgtgtctttgttctcattcgtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagatagtttgttataatttctgttcttttacatttgctgaggagtgctttacttccaactatgtggtccattttggaataagtgtgatgtgttgctgagaagaatgtatattctgttgttttggggtggagrgttctgtagatgtctattaggtccgcttggtgcagagctgagttwaattcctggatatccttgttaactttctgtcttgttgatctgtctaatgttcacagtggggtgttaatgtctcccattattattgtgtgggagtctaagtctctttgtaggtctctaatgacttgctttatgaatctgggtgctcctgtattggatgcatatatatttaggatagttagctcttcttgttgaattgatcctgttaccattatgtaatggccttgtctcttttgatctttattggtttaaagtctgttttatcagagactaggattgcaaccctgcctttttttgttttccatttgcttggtagatcttcctccatccctttattttgagcctatgcgtgtctctgcgtgtgagatgggtctcctgaataccacacactgatgcgtcttgactctttatccaatttgccagtctgtgtcttctaattggagcatttagcccatttacatttaaggttaatattgttatgtgtgaattttatcccgtcattatgatgttagctggttattttgctcattagttgatgcagtttcctcctagtaccaatggtctttacaatttggcgtgtttttgcagtggctggtaccggttgttcctttccatgtttagtgcttccttaaggagctcttgtaagtcaggcatggtggtgacaaaatctctcagcatttgtttgtctgtaaagcattttatttctccatcacgtatgaagcttagtttgactgggtatgaaattctgggttgaaaattcttttctttaagaatgttgaatattggcccccactctctactggcttgtagagtttctgccgagagasccgctcactgttagtctaatgggcttccctttgtgggtaacctgacctttctctctggctgcccttaacattttttccttcatttcaactttggtgaatctgacaattatgtgtcttggagtttctcttctcraggagtatctttgtggcattctctgtattttctgaatttgaatgttggccttccccgctaggttggggaagttctccggcatgatatcctgaagagtgttttccaacttggttccattctccccgtcattttcaggtacaccaatcagacgtagatttggtcttttcacatagtcccatatttcttggaggctttgttcatttctttttactcttttttctctaaacttctcttctccctgcatttcattcatttgatcttcaatcactgataccctttcttctatttgatcaaatcrgctactgaagcttgtacatgcgtcacgtagtccttgtgccatgattttcagctccatcaggtcatttaaggacttctctacaytgtctwttctctacactgccattcgtctactcttttttcaaggtttttagcttctttgtgataggttcaaacatcctcctttagctcggagaagtttgttattaccaatcttctgaagccttcttctgtcaactcgtcaaagtcattctctgtccagctttgttccattactggcaaggagctctgttcctttggaggagaagaggtgcgctaatttttagaattttcagcttttctgctctggtttctccccatctttgtggttttatctacatttcgtctctgatgatggtgacctacagatggggttttggtgtggatgtcctttctgtttgttagttttccttctaacagtcaggaccctcaactgcaggtctgttggagtttgctggaggtccactccagaccctgtttgcctgggtatcaccagcrgaggctgaagaacagctaatattgcagaacagcagatgttgctgtctgatccttcctctgraagctttgtcttagaggggcatccccctgtatgaggtgtctgtcggcccctactgggaggtgcctcccagttaggctactcaggggtcagggacccacttgaggaggcagtctttcctttctcagatctcaaactccgtgctgggagaaccacaactctcttcaaagctgtcagacagggatgtttaagtctgcagaagtttctgctgccttttattcagctatgccctgcccctagaggtggagtctacagaggcaggcaggcctccttgagctgcggtgggctccaccgagttcaagttcctagctgctttgtttaccttctcaagcctcagcaatggcggacgcccctcccccagccttgctgctgccttgcagttccatctcagactgctgtgctagcagtgagcgagcctccgtgggtgtgggagcctccaagccagccgcgggatataatctcctggtgtgccatttgctaaggctgttggaaaagagcagtattagggtgggagtgtcccgattttccagstgctgtctgtcatggcttccctttgctaggaaagggaattcccccaccccttgtgcttcctkggtgaggcaatgccctgcccagctctgtgggctgcacccacttgtctggcaagccccagtgagatgaacctggtacctcagttggaaatgcagaaatcaccagtcttctgcgtccttcacactgggagctgcagactggagctgttcctattcggccatcttggtgccaccctctgatgtttatatttcttattggagctttctttaaatatctratgatccttattggcccatttatttatttttatattggtgtcrttttacaccttcatttagggattatcaaaattcaataaactgcacatatttaaaatgtataatttgactggttttggccaatgcacacactcctgaaaccatcaccacaatcaatgtaacagacatttccatccttctaaaatgttgtcttgtaaccttttttagtttatctcgttacacttcctcatttccttctactccccaacccactcctcaggtaactgctgctgtgtgttttgttcctatggatttgtttgcattttccagaattctatacagatgagatagtatagcatgtattcctttttgcctgactttttttttttacatagcataatgattttgaaatttatctgcattccgtatccatgtgcatattttaaattgtggagtagtgtttcattgtgtgaatatattacaaaatgtttagccattttgttaatggacttcgggttgtttctagtttgaggctattacaaataaagctgcaacaaatattcatgtacaagtctttgtgytgacacatgcttcttcttttctcttgtttaagtatgtaaggagaggtaagaagtccattgattttttttttttttttaagacggagtctcgctctgtcgcccaggctggagtgcagtggcacgatctcggctcactgcaagctctgcctcctgggttcaygccattctcctgcctcagcctcccgagtagctgggaccacaggtgcccaccaccatgcctggctaattagaagtccattgacatttattagtgagacactacaatgttgattgggtgttacatgcatggacatggcttgccaaatggtggatttcattgcaaggttattgggtaggaagaaggccatttatctgggagactcccaaatatcagtatttgtggttcttttagccaggcgatttcaggtttgtgttttttttttcactaatgttttacacaaggagtgaatagtcaagttgaggaagagggtttataatttagttgattttccctgtttttaaactagtgtttttcttcttccctttatggtgattggtttccacagacctagagtctatcamgtttaatttatccagaaattaaactgttgttagggttagagaaggttgttacctggatgcttggaaggaagtatgcggggatggtctttcttaaagtccatagtcttaaagtatataaaaatcttctagcttttagtcttatcccatggccttgcttctgagttttctggggtctaaaaatccctagacttgcagggacactggagtagcagcttgcttcctgttaacattgctgtcttagctaagcataggattctgaagataagtcattatctctcctcagtcttttgccaccttccaaatatatgtgaatatcttcagcctgttattgtttcctctctcatgtgttctttttatttatttgttttcattttaatattgccatggttaaatgaagtatagattacatgtttattccttcaggaatctctttgtggctttggtaggtatttagacttatgtattagaattcagtatttaatggtttgcatctttatattttaaaagtatctccaacaaaccgctttttatttttcttttaattttttcaatattgttcatttattgtttgtagacttcttttcatgtttcaaagttaatttttaattataaaaaattaaaaaggaactaaaaattgaaaagtattaactagtgataaaatataagacacaaaattatctatatatgatgatagaactatacacaatatttgcatacaataaaataaaacaaaaatattataatactttttgtgttagtactaagccatggatgacatttctctaggcatttttaatgttgctacatagttttaaaaccatctcgttagtggattgccacatagtttaaaagtagtattgctcgaaacattttttggagaggaaaaatatgtgttttaaaatctgtgctggttggtatcaaacaatactttttctatttcattccactaagaatgcttaaagaacactattttctatgtaaaaagctgcaaattagcaagcttaatgattttttccagcatactttcatctctttgtatcacagattcactttgcyagagaacaatctagagttgtcttttaaaaaattattctttctaccatcctttaaaatgtagcacagacatttttaagtttattaagtgaaaaatgcctattccaacactcttttcatatctccttttaccagattcaaaacatgtgagtaaagttttgaaaagagacaggagaccaactcactccaccctgccccacctcacgccacccacccaccaaagtctgagtaagagtgagcagtgccctctcacttagagcttaattttctttgtgtgcttttatggagaattcggtatttaatggtttgcatgtttatattttaaaaacttctcaataaattttcttaagcaagaacatgtgttttctaatactgttttcatattttaaaagaaaatgcattttttaaggactcctgagatcttgtttcagacatacagattaggagctttagaaaggcttgatgattcctccagataaaaacaaaaaaaataaacacagaaacaaatgaaaaataatcgctgagttagaagaaaccttaagaataatttaactctcccataatgcttgaattattcattcaataatacttagagcatctattggacgctaaatccttacatatagtccagttggagatttggtcaacaaatgggaaaataacaatgacatttccaaccagttgggacaaaaagtgctgcaacaccatgtggcttaaacaacagaaatttatagtttcacagttctggaggcaagaagtctaagattaggtgtcagcagggttggttctatctgagggctgttccatgcctctttctagcttctggtagtttgctggcaatcttgttkgtttggagaagcagcatcacctgatttttgtcttcattcccatgaggcattatccctgtgtgtgtgtctctgtgaccaaacttcccctttttatacgtccaccagttatattatactagggtctcaaagtatctcagtatgacttcatcttaacaattactttggaaataactctgtttacaaatgtggtttcattctgaggtactatttggacttcaacagatgcattttgcagggacacagttcaacccataaaggttttctggacattctatagtgtttgtttgtttttatcctttctttagctcagtagattttgttcgtaaatctttctcagtgaaattatttcttttactattttgtggtcaatattttctgtattattgctatttgagactttattatatttatatttgtaatctagtatataatctatttcagtaaagtttccacgagcactggaaaaggcatattttctgtttaagatacaaaagttctcactactctatagatctccatacaatctactttattaaaaatgtaayttaagtcttacaaatccttctttatactttttaccttactagaacttggactgcatgagaattaagctactattatttaaatgtttctgcctgtttgtctttgcatctcctgtgttttctgcttcatgaagttgttttactcattgggtgcatagaaatgtataacactcatatctttactgtgaattgttccctttagtatatttaaactacttttctatgtcacatttaatgctttttcaaaagctctgaatgttaccttttcaaatawgatcatgactcatttttttcttacctctctccttcctttttctctctccctttttttcttttgtatcccactgtgcccgttcttctattgttatctttaggtataaatttgtatttagtgtgtccctgtcatacacagcatataatagagatatgttttgggagttaatctgaaaagttctttcttttaggaggtaaattaagcctgcatatttcttaatatcataggtatgtttgggcttacttctgtcatattaataatgataattattccatagtgcttaatattaccagactttattcaagaattatatataaatattttaaatttaattcttacataaaccatcatttaaaaatatatggtgaaactgaggtacagagacggtagtaacatactcaaagtcacagcgctagttacttatagagctgtgattcaaatttattctgattcttgaatttttttctctatcactacattatacagggtctttatttgatgccttttgtgataatcctgtataatttcttaaaatctattttcaagttcacaaatcatccctttcatctgtatctgatatgctgttactcattcartactattttaatatcaaagattaagttagtttagttctaaatacttcttggccattttaagtagccttttttggttaattagaaataatcagttttaaaatcttttaaccattttatatatggttggtttatactgtgtatctgataatttcagcatacaaattttcttttaaacttaatctgtattttgtttctgagaactctcagttacagtagtttgatttttgtttataagatcatctgttttttaacttaatctgtaagaatcctaagtgtttatgttggaaatattccctgagaaargatttggttgcattgccactrtacagaattccctaacatctaggatcactttagctccatgggggattaagggtaatataggaaactcacatcagctccctaaccttgagacagactcaaagtttaggtctcccagatcctaggccttgtatcagtattttctcccagaacaacttcctgtcacttattgattactcatggctctctgctcagattttagctcattgcctaccccctcacacttcgagatttcttttcctttctgtgagcttagccataaaaatatgtttgtcttaacttatctaagttctagttgtcttttagtgggaggactcttcaggataaagycatacttcaggaaatagtgatgtgtatgcacattttaaagacttctgagctrtatagacaaattctactctataaaggtcgtaataatccatactcctctagaaatgatttagtggctctggtcttcttaaaattgccaacacgggaaattataataaaataatatacatggatcatatgataaagaaaagtagtatctttgtatctttgtgttaagttgatttttttatagtagtgatttagtgtatttttgaacatatgtgccatttactttctagttacctggaaatgtagatgtagatattaggataggtctgacctggagatgtgcaaagctttgcccatagagtatataatccaaggagtgcatgtgcaacaacagtaaattaagacaaagagtatcccaggaaacatcagaattcatgagtcatactgagaagtaggagccaaagaaagatatggaagtgctcaaagatgacttattgggagatatgagtagtgtcagcaatcaaatgaagaaaaaattcraagaaagaaaggttgttatgagtgttacatgataaagataaataacataggatgaaggctaaaaaacagaaatttgaatttaaaagtaaaagtttccctacgaccatagctacactgctttcaggtaaggacagaaacagatacaatggaatagcaggacagtcctgaacaactactaatatagattcaatgtatcataacatattgagagtcagggatcttttgagactatgacggaaaaaattgatttttttttctggaaaatgctcacatgcacacacaatctaaatattgaatgcaatatctagatattcacatttcctctgacaactatctttatctggctttacttattgtcacctaatttaagaagtttcatcacagcagaaaggagaaataccaataccttcaggagaggataggggtaggttaaggtaacatgtaaaaaaatacctggcttttactaaacacatgttcattgaatgcttgttgatttttcagtagccaccaggaaagaagaggaaaaatataattgtcggcacagtgtccgcagaggactgagaggtactgggatcatgagtgtagtggagacattagtgttttagggaggagggacgtggactttggraatatcagtttattcagaatctgttttatgtcatgaattgtgttagaacattcttatgcaatgtctcccataatcttcaaacaaccctaatgttaccttttacagtgagcatttgagtgtttagagaggttaagtaactttttcaaattcatgttcgaaagtggtaagcaggagaatctaacctccatttgtcacacaccaaagctgccacactgctgggagagttataaagaagttaaaaaattacttactgtaagaaatattgaagttctagggaaggtaaattagggaaatttaagtttcaattttcactggcaaatagctgtgaatgaccacttgagaatagccattagcctggctttctcctctctactgacttgtcagcaatgtccctttcatcacctgaagcagtatccacacagatctgcaactgcttggccctgctgcctggtccctttcatgctgacagcattggaaacagggattggaccaagcttctgggaaaaaaaccaagttgtccacaggagattttcacatgtgagctaaaccaaaagggagaacaaacgggatataatcaggtgcatcacagcaatctgctatctcctaccaaagccactgagctttgcctttttgtttcttttcttttctttctttcttttttttttttctgagcaccatcccaaaaataaagaaagaggctacgaaccttccatatagtagaagtcttaggattaagcattttttccctctatgcaatattactgttcatgttggttcagaagatctttagctctttgaaactctgtttttatatattttgttttgctccatatttaggaacattttaaaaatactattactttctgttgtttatgtttgaattgtattgcaatttgatctcctgctaagtaacttccaacttaagtagatatgataaaattaacaggctccaaatatttatttctcttagttataaattcttggtaatgaatactgtgtttgattaaaattataataggggttttaagcagtaatgtgtatagtcaaaggaattctgattcgaatttgaatgtttaaacagaccttataattatttaagggggaatattctgttattttgttgtagcactgctcagagaggtagcatataattaaagttgaaatctaactattttataaccactgttcgaaagtttaataacttgtgccaaaagtgtctttgaagatcagtggtttcactttaaatgtaaattgagtgggacaaactggccaagcttactgagatatttttgcatacaccttatgtacttcccccarttcctacaagaacaatcaaccaaacaatgaactaaacaaacatgtaaagcaacaaggaaaaaacattttttagtttaatgtttcagcataaatggattgaagatatttctcgcattatgcttttggctgtggatggaagagccaacacttgtgtattctgaacaaatattttgagtttcagaggcccagagcaacaaagttttgtctataaacaacagatgacaggtattaattaataaagagtgtgttcatatgtaggcagccttgacggactcttgattcatggctggtattttcagacacaaccacacatagctgtagtagcactattaataggaagattcaaataaatgttcaattagaggattcctcgatcagatgatcttattgaaatcaggtgaagggaggaactatggtaataagccagttactgcaaaaatrgaatgagattaattgagattttacagacactatgacattggagttgtaagactaaagccctatagggcttttaatggctcaaacctcatagaattttgtctaactgctgccgtccacctgtcctagtttttcctctcttcgcatttccagagatcagttcagtttaggggatgttggtctgtagtgaaatgcttggtgagatccaattctaacctttcaacctatgaaataaaatagtagaccttttgagtgagtatgggggtgatgcaattgggtgtttgatattttccatgagagtatgagaccctggaggcatcttgaattcctttcaatctgtccttcagattttattccgagatttcgtttatgccacacactgttaaccttctttgaaattcaggaaaagtcctcctaagggcaatttcaaagtcaatctaaactgggacccaaaggattaggggatgttggtgagcttgtgtagtatttatctgacctcagatatttagaaacgtaacaaagcctggtcttggcacactgtatattcccttcaataatggtctattcctaaactttcatttttatttttatgattttttttttttttgagacggaattttgctcttgttgcccaggctggagtgcaatggcgtgatctcggctcactgcaacctctgcctcctgggttcaagagattctcctgcctcagcctcctgagtcactgggattacaggcgcccaccaccatgcccggctaattttttgtattttttagtagagatggagtttcaccattttggccaggcttgtctcgaactcctgacctcaggtgatccacccgccttggcctcccaaagtgttgggattacaggcacaagccactgcgcctgtcctaaaattttactagtagtatttataagtattataaggcatctaaaaaaaatgcaaggcaccaaatgtatgatgctcctggaggtaatttgaactttcttgagctgcatggagatttttctttaacaggtctgtttaggaatatgttgcaggtggactatagaccacacttggagaaactgcactagtaaaacaggacaactgacttgttttttattccaagcaaacattgaactttgtgacctccatgcttgtacctctcaggttacaaaacacattttgccatgtcacgtatttgtctatatttcttatctattggcttccaagctgctaacttcttatttactcagtgcctccccatrgtgccttgtacacatttaggcaccatgttattacagtgtgatggttaagagccagggctttagagactgacaaactgggttggaatacaggctgtgttgttgctgtgagcaaattaatatatctgaatctctagttcctcatttataacactaagtaacaagagattttaagttacgcagtatatgcttattaaaaaaacccagaaatatatgtaagaaaactattaaaataaaaatcaatctaatttcacctcccagagaaacatgactttttttttttttttttttttttttttttkgagacagagtcttgctctgtcaccaggctggagtacagtggcaccatctcggctcactacaacccctgcctcctgggttcaagtgattcccctgcctcggccttctgagtagctgggactacaggtgcgtgccaccacgcccggctaattttttttgtattttagtagagacggggtttcaccatgttggccaggatggtctcgatcttctgacctcrtgatccacccgcctcggcctcccaaagtgctgggattacaggcgtgagccactgtgccyggcctgaaacattactttttaatttatatttatttgcatgtcaatttaaagtaatgtgccattcagatcatttttgtgtgtgcctttttttaaagaacatgctatgaatacttttccatattaataatgttttaccttgtaactttaaataaccatattttattcttattgtatttgtataaaataattccataatattggacatttaattttttctctctttttttttgtactttactaaaacaaagctgtggtgaatattcctttgtacaatctcttgtcaatttttttcttgttattctaaaaagaataacttaagactttatagtcttaagactatatacataagtcttaagactatatacatttttaaagattttatgcttactacttaattgccattgaaatatttatactttcatcatcagtgartgaaagatctctaccaatgttacctatcataataaagaacactttgacaatttgataattggaaaacggcaactaatttgtatttcaaaatttatttttaattcagcaaatactaatatgcatctcctctgttccagtcactgaatgttgggaaggggaagtgattgagaggtgagcaaggcagatcaagtttctactttgatggaacttaaagtctaacaactttaaacaagtagcaattaaaggggtgatgataaggagcatttaaggttatgttccaggttcagggtgttagattaagcctcctaaagtggcacttacagatgaattgaagttagccaaggtgggaaaggagggcaatgcagggaggcacagaagtaaaatctttctggactggccgatgctggagaaacagaagaaaacagtttggttagtgcgtggagtataacagaatgattcaaaatgaagtttgagaggtagttaggggtcagatcccataaggccttggaaggtatgttaagattgaggacttcattttgagggttagatgtttcattttaagaagataattctgattgaagtttgagaattgagtacaagagagcaaggatacgtatggggagcccagatggaaggcaacagtgtggcccacaacggcttgcagtgtatgttattcagaactccttggttgcaagtgatagaaatttaactcaagccagcttgaggaaaatggagaatttgttgattcttataaccaaaacatgaaaagtagaagtttcatcwgggcctctcagcagaatagaaacccaggactccaatgctcttaagagtctctatctttccccctccccaactttcctgttctcttctcttattcatcttttttctatccttctctttatatctcaagctaattatctcagactgacttcctccacatggctgaaaacaaggccagaggtgactcttgtaatacaaatattattgcctcaccatctggaaagggacagatcttctctcctccccttttaaaaaatagatcttaatttttacaggaattttaggtttacatcaaatagactggagtacacagatttcccatatgcctcctacccccacagctgtatatactcctccattaacatactctaccagagtagtacatttgttgtgactggtgaacccacactgacccatcattaccacccgaaggccgtagtttacataagttgttcattttggtgttgtatagtctgtgggtttggacaaatgtataatgacatgtgcccgctattgtattattcagagtagctgcactgccctaaaaatcccctgtgctccatggaagatagtatgactattaataacaaatggctgaattgaatagatattaaatttaaatgataaagatgtcttctgsctttgattccttgtggttgataaatggctcaaagtgcaatggaaaatgagggtgaggatgatacagaatgtggtgttatagaagccaagggaagagaaccctttttaaaaaagggagtaaaaaaagaatgagatccagtcatttgcaacatgaatggaactgaagattattatgttaagtgaaataagcctgtcacagaatggcaaacatcacatattcttccacttatttgtgggatctaaaaatcgaaacagtagaactcatggacatagatagtagaaggatggttaccagaggctgttaagtgtcatggggggctgtgagggagaggtgaggatggttaatggttacaaaaatagacagaatgaataagatccactatttgatagtacaacagggtgactatagtcaaaaatgacttaaccatacattttaaaataacttaaagagtgtaactggatggtttgcaactcaatggttaaatgcttgaggggatggataccccattcttcatgatgtgcttattttaggttacatgcctgtaccccttctcatgtaccccataaacatatacctactatgtactcacaaaaatgttttaaaaaagggaatggtccttattgtccactattgctaaaatatggaaaaagagaaagactaaaaggtggatgttgaatttagcaacactaaagttcattggacttcctgatgaagaaagcatagcacaatggtttggctggaagtcacaggggttgagtaatgagatgaagaattaaagatggcaattacaggcatttctattaaaagttctttgaagtttattattttaaaatacattaattggtttgctatttattctttgtaaatctgtttctattttttgtccatatttccattggtggtatcttttactttttgacatataagtgctatttatataatgctattaaatttgttctatatgattcagttttccccagcttccctcttccttccttttttccttcttccttccttccttccttccttccttcctttctttctttcttctttccttctttccagagttggaattgctctttcacccaggctgcagtgcagtggcacgatatccgctcactgcaacctccgcctcctgggttcaagaaattctcctgtctcagcctctgagtagctgggattacagacgtgcgccaccatgcctggctaatttttgtatttttagtagagagggggtttcaccatgttggctaggctggtcttgaactcctgacctcaggtgatccaccccctttggcgtcccaaagtgctgggattacaggcataagccaccgcacctggcccccagattcttaatttactattaatagactttattttcttggttgttgtttctctaaattttaactttttgatataggcattctgcctctggttttgtgtttagaaaggcttataaataggcctccatcatagcctataaatagttacaacatttttgtccagaacttttttggaatttcctttggggtatggaaggaagtagaaatttaattttttttctaattttttctcagcaagttttctttaaagttgtttcactttaaacaataagtttctttttaattcaacttatcaaaagaatgactcctctrtatgttaaaacacacttcatcttacaaaacaatgcagtcttgacagatgggctataaatagtggctttttttttttttggatgtttgaaacaaatccgaacatagactcagtcatgttactaagagctttcacaaggagtgaaggaaatgttcttctttatgtaggtggattttcattggaaattactgttaaatacaaatgagcctactattaatggcaccaatggtgtatgtatggcttgtaattcatcttgtttccaaatgaagtacatgggaagtgtgagtgttacttttatgggggagtagagcagacagtctcagttatgtctgcaaattcaagatatgtagtatctgatgatgttggaggttgggtcacacaacatgtcaaactccaatcaaaggaaaattacttgggaatctgtaacttggtacttatcattgctgggaaggtggctatgccaggggcttttgctgaagcaagaacaaaagtcattttcctagtcattgttccacatatgttttttttttttgctaacatatcttctaaaaataaagtcacatagttcacaattatggcttgatttgaactgtacacgctaccaatggacatttttctgaacacaaaaatccatcatggatctgtatcccgtgctcagtaaaaatatatccgtgtttgctcttcagcacagctctctcaccgacagttctgcagaagtgggtgagttcttcgaagatcaagacactgaaagccacctctggaatagtgaattaagtaaatttactagtttaccaagaatattgttttacggattaatctgcataatcatattgagtgattttgtatatggcttctcttaaacatacgttatttactatattaaatgagtatggtttttttcttgaatatatttaataatctactgaagaacatattcagcatgaatatattcttcataaatgcattcttcctaattgtagtgtttagagtatatttttcacatataagaatatattcattaatttattcttcttgattatgtttgtagaactgctttattggaacatgctctttattaacatatttatactcgactatattaagatatatacatgttatatattctatatatttgttaacaatattcacaaaaaagcaataagcctaggatccagcttctggcaaactgaacattatttaaaatgtatttaatgagaatgtgtatatttaaaaataatatttcttatactaaattttagtaaatttgcaaatttggtgaatttggcaagtttgtcacttggtgaattgatgctgttactgacctcgggtttaattctgttatcaatttacttacttaagaaagcataatttgtgattgtttttcaagacttaaaatggaaaaaatacatttttgtttcatagctttcattcagccgtttcaacttggcttctatgatgatgtaataaaaaccaatttaaaatcaattataattttcaacaagatactgtaatcctattcctagaactgataatgatttgattttttaggattagttatttatctaagatgaatgagcagagttactgtctttgcccaaaggaaaaacaaaagatgtaaccctgcatgccaacgaacccatcactctttctctggttctaacattttagaatagcctggaccattcttagttcaagactactttgcttacatcataagaattgagtcacagatttataatgatttactgtttctactgcaaggagaaagcagattccatctgaacatgctactttcacatgtatttagcccttattttctgagatttacagaagaatgaactgaatttgcaccataaacgtcagaagtgtaaaaaaaatctgcaattttacttagcaaaaccaagcaggaaacaaaaagagatcaaaatcaaaacaaagccctccaatgcttgaagattaaaaattaaccagcttcttttattgtgttattatggcttttagtatttttatgataacgaaaagtaacatttacccaccctttcttatggagtttatatgaataaactccttgggtttatataaatatggaataggagattttggggaaagaacctttattattaacagtgattttatcaagaaaaggtagaagcaatattgcaattagttatttaagaaatagggctaggatttactaacatttgagttcaatgtaaagaaaaaaacccattctaaatctaaaatcccaaactgttaccttttctttttttaaaatctcatttgtctgtaacttgatgaatcaaatgcattgttaacattgaatagagcaggactttaattcatatgtttcctttatcttgtctttctcttatgcatataattttctgctgcattcattcagataagaaattcacagcattatatgaagagtcctaaaacgtctcccagactacatatatgtgcctctttggcttcaagtgtgctaaaatttctaacatgtgagccagtctccttaattaaaaaactaacaaaaggcccctattaaaatatatatctaactgggaggggcatatcaaattcaaaagtaagaaggggtaatttattgttatgaatttattaattggattagctttctggcaactagaatagaaccaaggtatggaacactatggaaagtgagtcaggtgaactactgtaacttaggcctccatgaagccgagtatcagaaacataggtttctggtatgatggattaaggagagagggctcttccttggattatattgtctctcagcttcttattatgctaaaattttatgattctgtcattgtagaagttcccgaaaggcaggaaatatagttttttaatagatacaactgatagctcataaagttgcttaatgtacctgtaacatcaatgctacatgcaaatggtcactcagtaaacaagatttatctaatttttgaagattcatgaattcacttatgaaagttcaagtttttaccgctcatcagtaattttatcatatttaaaggacactatttatcaggcaaaaggaatatgttggacccatatgattcctttgcttttcttcagccattaataggcattcttcatactttctgcataacaactggtcttgagggtagacacagtaagtgtccatctagtgggtgtgatttgaaaggtattgcaaaattttgttctgctctgccctatttccattccaatgcaaatgtccattattaacattttccctttgcatgaggtaagctaggggagagtcttctcctgtgttttataaacatacatatttttttttctggaaaggaggatgaggattagttatcccttaatcagaatgttctttggttagctgatgtcatgctgaaaagtagcaaaatgaggtactcaagggatatctaagataagaaatagatgttcacaaatcctgcaataagcaatttgtggtgataaggcaaacattcaatcttgatgaatggaagacaactacctactaagaacagcccacttgcatttaaccttgaagttgtcttagaaagctgtaagaagttacacttgagaagcaagaaagaaggtcctgcaagaaaaaaggggccaattttgtacatgaagagccagatgaatataagcaataagaacaaacatttattgatcacctactgcgtacaagaccttgccatgagtgctatatgtgaagagatattaagtctcatttgtaattagttctcagcacaagtagaaatgatcataggactgggaatatttagttctgaaaatgttctaaggagatgtcagagaaaatgggcaaccatgtctccatggcccaagaaaatatgaacctaatggcatgacaagtttgtatctacagagtcccaaagcaacaggtcaattaagtaagtctctctccctgcctttccacatctggtgccacagtcctctgctaaactgaagattccaaaatgtgtaactctagccttttgcctgagcttcagactcatgtcctactgcccacaggacatacccacctggatgtgacgcacaggtcatgtcagcrtaagtatgagcgtatgttcatgttgaaattgagtgtacttttccccctagagctgctctctgtcctaattttttatcgcaagtactggtactatcaagctagaaacctaggaatcatctttgatacttcctcctcctctttcatcccatatattcagtaatcactaaagatgttagttacaaatattaattaattctcaaaaaaggttttattttttatgaatagatgattctatctaaaatgtttaattttagatcgatatgcttgtagataattataaaatttacttatttattacatttggtaatattaaacatgaagacaatattctttgtcttatatatcgtgctatttaatttgtgacatayaccccttatgttaaattaatgttgagagaaaaagcgtggcctgttaagaaataaatttatagatgacattatgtcatatttgtagattggagtttactatatgttttaatttgttaaaataagaggaagctgattttttatgtttggaatttttatacttaaaatattttaaaagtgtaatatattaatacacttgtttaataatgttggagtttaaaatggaagaaataagagtaggttttgtataagcatatttctctaaatatgaaaagcctgcttatgtaaaattctccatcctattactcttttttcaaaaataggtcttgaagcagtggaaaaataacatgaggtagtaggtaaatattttgaataggtgaatgaaatttactgatcagatgaaggcaatcttgagagaaatgtataacattatcattttatgctcctcattaggttatattttgagaccagtgctctttatgcttcctgcctttagccatggtccattagaggtagaaataaaacagcatataaccacaaatatagatcatttaaaattgtctaatgatccaaaccaccatgctgacaaacggtattcagctgagtggcaaagggaaggakaggtgagtcatatgcacatgctcatcgattaawcctcatcccatgcctcatttatacatacacagagctccaaactgttccctttacatgatttaaatcatcattttatttactsgtcccaaagtagaaatctgaatggacactatcccgaccttgaaccattttatacatacatagagctccaaactgtttcctttatatgatttaaatgattattggctcgtcccaaagtagaaatctgaatggatactatcctgaccttgaactacatgcagccagtttgagaagttctgggaatcaacgctggatgcgtcctagctctaactaatatttcgtgactccagtcaggaacattatggctgcctcaggccagttttctaaattacactctaagtaataaaaaaaggcagaaaaattggagactgacagaggttcttggacaacacaaaatacaataattagagaaacaagaaaacataccaaaacctgaagtagtcaagaacacagcattaacatggatcaaagtgttcttattcttattacatttttaaagaatcaattccaatgatttttaatgactttttaattggtgaaaacataatgatccttgtggaaaacagcatagaaattcctaaaggaaaaataaaatcaaccacaggattatccactttctggataactatagattatacagaaataaccacttttaaaattctggtttaggtcctccagtgttttatctaaatgaatacatcaataggcatacccacacccacacacacctgtggagaggtagcttagggtagttacgattctctagggccagacttcctgagtctgaatcctggctctgccacttataaggtgtgtgactttgtrcaagttacttgacctctctgtgctttaatttttacatctttaaagttgggaataatacttatgtcataagattttaggagaattaaatgggttgatatctgcaatgcccctagaacagtgcttggaatatggaaagcagtatatattgtttatatttttattattatctctaattgtatatagttttacaaaaagcaacatcacattgtatgttatattaaagcttgtgtctttccaacttggtgctagccctttagctgcctcttcatccttttcttatatgttggggtctttgaaagtgctyagtaaataccacctttctttctccatcttaattgtaaatcattttaaacccgagacagacaagtattgcacgtggagtccaaagtgtcaattttaccactaggcaagctcatagtaggaaatgtggcttaaattagaggatccaatggcaagtggatttcctcatagtgaaactccaaatagaaggactttccatgtggtcactggattacgtcagtgttacccacatgagtgactggggtatggagaggaaaggcgtgctgtgctaatggagctaaatatatgcggaggcaaatactaaaaatgagaaacaatattaatcttttccttttctctttttcttcttccaacgtggaaacattttactattcatttttatatgccttacaaaattatgtactgtttgtaatctggctgctgaagcattggtaacaaagcaatggtaacaaatacggtgtatgtatcatcaagtcagtccttggacattttccccacacacataacctaaataagcaaactgtatatattttgctatgtgaagacttggtgactatgactgtgtttacatgatgcaacagtgattagttaatgtatgcaggttggttaaaaatcagttgatttgacaacaacattttgttttatttggtatgacatagaaattgcaatgcctgcatatgtaaagtggggagctgaccaattatgcacattgtaaatctcctgaatttttttcttactgagaatcagaagagcattgaggactgaaattatgttgttaaatatgaatagcgacccttcattcaatgttgattgcatgctaattttatattatatgtttatataccatacatctttcatctaactctattgcaatgattatggttgtgttggtcatttgtttatctggcctcacacccattctctcctatcctctgatcctctctgtatcccaagagaataactcctgcaaactaagttttccactccaatgccacctgacttccttttatgtatgtcagtgggaagtactggtgtgagactggggttgtggagaaggggaaagcaaggtatttctgcctctcacagcttcctgcatgtcagcccttcccttttctgatatagcctttggagtgggagtgactttccactgctgtaaatctctgagttgcccacaatcccacaattttttttagctcttcttatatcattataactagttttccatataatatccctctattaaattatctattrtgagttctattttcctatcaggaccttgacaaagatagagactgtcttcattttgtagaaatattaagtaacttgtacaaaaacacacggctagtttaaaaacaggctttcaaaccagttgtacctaatttcaaagcccaagtatttgaactactatgctgcaatcaagtgatcgttcaaatgaatacccaaatgaatagttttcattaatcacctctttctattacttagctcaaattgtctgcattatggcactaactagctatcatcatcacttaactatctatctctcccaattgtttataaggtcacttgagagcaggcacattttattcatctttgtatccccagtacctactactgtgcttggaatgtagtggattcttaataaatatttgtagaataaatgagtagtaatcactgtcattgacagagtgactattttatttcagcagccctgcaaggagtcttatgtaaattttataactcaatcttcatgacaatcttgcaaagtagtcataaatatttcaatatcagagatgaggaataggcwcaaagagtttaaacagctcacaattaatctgctattaatgctaggctaagtggattacaaggtctgctattttgactatgtctagctgcctccctacataaatttatgtgaaaaatacataaataaatgtgttggaaaaaactcaaatcattttattgaattttcaggtttttttttgagccttataaacagataaagtcttgtctctatgagaaaaaggagcagctcagtgtttacatgccatatattggcacgtaatggaaatacatatgtttgtacttacctagtctacgcagataaaaggaaaataagaattgggataataatctgaagaaatgacatagttgatattgctgccaaactaaaatcasagctggacagtaaagtggtaaaagatttcattaagggactactgcgataggagaaaagagacctcagtgtagtactgggctcaattccgaatatagcttggacagatggagatttttagccaagcagcagggtgggggccaggggatggaaaattactaagaggaaacatcgggagtaaggagggattgtggctaaaccaatgtgacaggatttttactgactgaaggccaggatgatcagatatcgcctggggggttccrggggatgtagaatttgatcaactatcaagatgatcagatatcaagagtgagggattctctccaaacagacttagcaagattctcactacaattaggcagtagagggttggacaccaagactgaggcctagagcacatagaggagtcagaactagacttaggtaaaggagttcatcctgttatcaagtgtggaaaatgctggttagccacatgattatctactcattctctagaattacttggtatggtgtgtgacattgatgatatttacaaccaattcccctaaacacagaattcaggtttcaactttacttttctgttgcttggtctattatctagagttagtacattatctaaagtgatagggtaggtatttttactgatggattgttgatgaaagtgtttacttgtgtttttgtgagttccagtctttgctttgcatggtgaaatcacatgtatggataacattttatggctcagttaagtttctgccatagtttttccaagcaatacattcttagtacctcctctgaatctagaaagtaaaataatacttatatttataagactgaattgcagaatttattattttattctttagtttctggtgaaaatgaaccaakagaagtaaaataatttggtagacaaaatacaaaaagccattgttgattctacatgtaattcattggcacatacttgcttggattagtattggttgaaattgtttcagctggataccacccaagaggctgttcttgtctcacagagctaggagccatttcaagatcctggaaataagtgattttcataagatttttgctrgtgtaaattttttttttcccyagggaaaggatgatctcctaagtcttcttcatgtatgtactactagctttgctgtaaagtaaggcctttatttcattaattygagagtagagaataatgtaaaattaaacacaagcattttttcccagttgatttctaacaatcacaaactatattaatttgtttaatactgcaagagcacaaacaagatttgttttatatttgtttcataaaactttgtattattgttttataaaactttgtattatcttgtgattgagacacatcattaggggctggaagccaacaggtgtcaaaagccccagtgttgctgttcaatggatatagaattacagtcatgcaagatgaacaagttccagagatctactacataacaatgtgtatatagttaacaattctgtactgtgcacttaaaaatgtaagagagtagagttcctcttatttgtgtgttttttaaaatcccaatcaaacagaaaaacaacacaacacagagctatgaccagcaggcatggaagaaatccaacgtttgtgtgagaaagcatactgaagcattacctgttcccatttgaatgctgagaaagagttagggaaataacatgattctccacttaataaaacttcagcatgtctttttcattagaagtgatgattgacagggatttgttggtgacactgtgtggtcctgggagcagaagtcactgtgtaaacaacactgtgctaacaaaagaggactgttcacatggctggcactagcacarcctcgagaagatgaaaagacggcacacggaatttcctgatttggggccaagatggacaacaatgactatgatattaacygttggattttatggatttttattgaataaatggaatagattttgttaatttgtttattttcctccatgaagatgtttgaaatgtatctgaaaatataaaatattttcatcatataagttggaaaactagggaaagtttagggttaatttaatcccatgtaattcttttcaagtgcttagccttaaatattacctcttacttcagttaagataatagttttttaaccccttttttcaatatgttaaaacattttgaagcaaatcttccagacatagtgaaaaaacctgctctagatggttacttagtgtcacaattcatggagggaactatatagaattcccctatatggtgattttctgtggcactacctccagcttttatgccctctggctatatatgaaaaaatagacatttaatatagtaatgtttttagccacaaagaagagtgaaggcaattttgacgtgggagaagaataagttctctcccttagtgtttgatacggtgactatattgggctaagataatggttaggagagagagaagagaaaaggggagagagattgggttctaaatgcacgagaagaaagaaatgagggcagttcagaacaataacctgtgaattttttcaccacttacataccaagcaaattgcatttccttctacactgtctggttctattccaatgtgttttatttaaaagttttatctttcccaatgaaagtttaagttccttggaatctgggtccaagtatcttccacagaaacatacttctctcgctagtttatactctctgtaggcacgtacttggctttcttgctcactgctgaatgctggtgcgtagcaccatgactggcacagagtagatgttcaataartatttgttgtatctgtgagagaatgtgttaaaataacaaaactcaaacataatagtgcagcgactatgccttratgtgtgtgtgtttgggattcagcacatttgtagaggtaaagcagttggttttttaaaaaattagtgccattcaggatcacttgttaaatggatattgtttaaaggacwtaattaattaatgctggggatactgttaagaaatcattctagaaactagaataaatattgccaaagtgaaacactttggttttgatacaaattattgccttagtttcaagatgtaaaacaaacaaaatctttgatgggattagtagaatttatttgagtttaattcaactttttgttttacatataaaaatgtgtgcctgtatgttatacatctgtacatatatttccacatatatctatacctattacgtatagctacatatagatacccatttatatgtttaatctcctaagtcttacatcttagtttgcaatcgtgggattattttccagatcatagaattgtttgttatttttactaggttgttttcatgattaaaattccgtgtctccccaggtttccatgtatcagcagtgccccagaaagtgtttcccttcctgagactctagggaagccttggaatgcaaataacttgaaaagagagcctggccaaaaaaagatttttgagccttggtagggttagtgaagcaggtttttagyacaaacacaactcaaagtatrtgtgttattaaaagtagctattttcatggaagtcttttggtactatttgttttggctagagaagtgaaaagctttcttttaaccatgtgaccattattttgcaagatcataacaaacaattctaatatctttaatctcactaaagagtcactaaagttatttgatgtaccttttgaaatagaaaaccaacaactaaatcttctctaacaccatgattttctaatctgtattaaagcgttccaggtatttttgtaatgcaatggatttcaattatgttgttcattttcagcacttacttcaaaagaatgatgctttacaattttgtagttaatttaacatatttttttgtttgcttgaaagggtagaagtaagacatatcaagatttaaaacataaatagcttggaacaccctgaagagcaacatgggagaaactgagaaaagaattgaaacccatagaayaagatgtctttccaagttgaaggtatggaatttttgtatgtggatatatgtgcatgtacactagtttttaaaatacgacagtcctggtaaaattgctcctatctgcatgaagtgatctaatattaatgccrtattgcctgttctattgataatttcttgcwttaaagaagttggttttataactgagggtgtgtctacacaggattattgattcaggcaagttagtcctaaatggctttgagagacttaaatggaagacaggatcctaaaaatttccaggcacacatactgtggcaggatttatttttctggatcaaaggccatgctcactcttgcagggtttctaacccagagaaatgtgggagtcactctccgaaaatggctcattgcacagaaatgctttgttgatttgtatgcaattacccagcaaaacaaatgttttctttaagctttggcaacataacaataatttcctrtaagaaaaatggccattttgtcagctgttctgatttttttttctatttcagagaaaattctgttttctagcttcaaagtcatttmtattcaaacaaatttgaatttatgataaaccaagggatctggacatttgtcctgattctatagctagtgcctgcaagtggtttcaaaactaagacactgtcactcattttctccctatcagaagtttgttttccatttatatgtgtgttggggaaatttaaacatgtatacaaaattggagaattatgatataaatctaaaaaaaatagacttgcctgaaatggtatgttaattaagaaaaactttttgtgcttcagttttctcatctgaaaagggtaatagcaacattcccaccttataggattcttttatgtttgaaacaatgactggaatattgtaaactttcaataaatattagctattaatattaaaagcatttgtggagaaaagtcaagtggtatttataaacaagaggtctttaatttttgattgctttggagtttagcaaggttagatattaatgtggatgttaagacaaaatgctgtaagcacaagtttatcaggtaaaagtgagaggcaattgcttaatagcaagttaggtttctctgtttctctgaacttagaaatatactcattaagcaaaattcattaggaagcatgaaagaactatttttaacaaatttgctttaaactttgttgttgaaataagttgaaagggcattattgctagaagctagtaggacyagctttataaatacagagattatttagcactagacatgagtcagaatagccactgatttctttcactctgcgaataaaaccaaactagttaggcaacccatgygttttagggraaaagcaatgaggtcatgatccatctaatttcttttcttaacatgtaaagtagaataaattatttttccaaatttgatttgtacttgatttagtaggacttgcttttaaatataaaatctgatttataaaactaggtgaaaatagtttgctcttaagaatayactctgagaaggtttatagtgggaagagagaatatccacaaatggtattyaatataaaaaatagctagagatatggccatactatgctgtagtcaatcagttttgattcatattaagaatgctattcaaatttctaggtccttttcacataaatttctatttaggtctcacaaaaataattgataaattttggcttagatgtattgtgtggtgtgaatgtgtcccatccaaattcccatgttgaaatcctaatttctaargtgatggcagtaggaagtggggccttcgagaggtgattargtcacaaaggtaaagcctttatgaatgggttcagtggctttataatagaggactaagagagattcactgcattttctgccatgtgaagacacagtgagaaagatggtagtttatgaatcagtatatacagcctctaagccaaaaataaaattcaaccctcccaccccctgctcccagcactgaatggacctcctcttggtcaagagccttccaaagttagyctaaaaaacaagtttargctgttatgggaaggaggtgttggacatgcctctttataccctcctctcttttggaattcargaataaccaaccatcattaacatcaacacagaccttaagtctgataagaaacatttatatccattctctatgaagcctgcgtatctagaggctttatctgcatgataaaaccttggtctccacaagccctgattgtaaacaggaaataattttttattattgataataactcttccaaccaattgccaatcagaacattttaaaatctacctgtgacctgcaagttcctgctttgagttatcttgaccttcccaattgaaccaatgtaaatcttacatgtattgattgatgcattatgtcttcctaaaatatataagagcaagctgtactccaccttgaacacatgtttttaggacttctctgaggctatactgtaggcatgccttaactttggcaaaataaactttctaaattgattgagacctgtctcagatacttttgggttcacaaattagcagccatgaaaggattctgagtggaggtgcccctgacctttgatgaatctcctgtgggtacttggtaccagcctgagctatccttatggctcaaactgataggacaatttgctgaggcctgggagcccccacccactccagagaatccccaatcccctaaatttggttaagatctaaaatttatttttctctacaactcctattttttagttttacttgtgtccaacaaagaaggcaagttttcctgcttccatgacaatggagcgtgggcaactcctttctggagtttcagctaatttccaacagggaaggcaagtttgagctttttttttcctgcctgtaagatggtaaacagcagtcttgagccagggtctcattcctagataagtagctgagttgggtttttttttttatctcagcgattctccttaatgactaaaaattagaattgacagccggctagtcttaatttctccttagcattagagtgctcagtaatcatattgttggggttttttgttgttctggtgtttctcccatcagatttgaccaactgtacccaacttggccaaattcaaatgagaattccaaattatgagcagccagacctctgaagctgctaaaattcctcatarctgaaaaaaagaaaacaaacaaattatgcgcttggtttctgttgcagcttcctgtcttaaaaacacaattgttctttcattttcttttcttccacactatttctccttcccccttcactgtctggtaccaaaaaaaatctagagaagccatcaaatgacttgaaccccttaaaacactcagaacaaaggcatcactcaccctttctttctctgtggagtttcaagagtcatgggcagattcttcttaaggtctaaagtgttcttattcaaaggtaaattatttttgtctaattcagaggttatttaaggattatatataaaatgaggtaaaaaggaccaggaaataagagatgtaaagaaagttataaagaggtatttttggtaagaaagcttaaaagaaaagtaattttatatgagaaagaatcttgcatgatgaatttttgtcctaagataaaatgactcgttcaagaaagagaaatatttatgtcaaaccagaaagtccaagcatgttgtaaatggtctgtgtaagttgtaataaggttagtaaaacaggaatttgttaaaatgttatgtgattcagttggctacaattaaaggaaattataatagtttttctaaaaattgaactttgatattaaaagtacactcatgcaacactaaagaactggttagaacaagatttattaaaaatgttgagttactcttaatgcaaggactttaaaatttttgaattctataatctttttctttttaaaattatttagattgatatctcagaacctgtgccctactgcttcagtttttttctcttttgagaaggcctggaatggtaactctctccttcaactttgtttggctcctgtaactttttacttttattttattttttttgaggcagggcctcactctgtcacccaggytggagtgcagtggcacaatctcagttcactgcaccctcaacctcccaggctcaagaaatcctcccctcagccttctgagtagctggaactacaagtgtgcaccacaaagccaagcttttttatttatttatttatttattttgtattatttatagagatggagtgtcacatgttgcccaggctggtctygaacacctagactaaaatgatctgtctgccttagtctcccaaagtgctaggattacaggcatgagccatggtgtctggcctttttaagttaatagttgaaactaagaaacagaatttttgaaaataggcaaatgaaaaatattttggatctgcttttgtctgtatgtctgttatagctatatgtttatatgtgtcatgtagaagtaatatttcactaccaaattatattaaagacctctaatcacttggctaaaagaaaartaagtgcttttcagactgaaggaagctaccaaagatgccttttaattcatatgaccttagtagttttgggtaagactaatctggtaaatttaatctcaaaattacctccagtagtttaacatcttaaagtcatgttatgttaaattaaataactcctatttttttcaatgggaatctgggttactaagagttaaaatagtaggagagtaaatagtgtttttggtaaaatttataaaaatacaatgatgtagcttttgctaaagaatttttttttctaagagttattttaartaaagataaaaatattatatagataaaactaaatggataaagagagaaattaaaagatgagtgaggagaaaccttgactccagggtggccatgtggttacctatggtagggagatgcagctgagctacattcaattacaaaagataaaattcattagaatttagagatggattatgctcccgaggagttagytctctaaatgcataaggagatgcaaactaataaaaaaaaaaaaagcaaaaatattcaatcccttggttattgttatctgtarttgctaaatgaatgtacaagaatgctgggttgatccttaaggctggatcaggcccagaggtgggtctgtcccagctcaagccactagactccaagctacccacagaaagaaaaattaaaccagagcaacaaaagttacctctgagagctgtggttaccaagaagatagtcaatatgtgggaagggcaaaaccaagtaactattaaaaccagagggtataatgcaaagtaattgttccattttgtagatcaatataatcagcttcttgagaaaccttaactactttaaggaaagaatcctttattttgaaggctacaaaatgaaagagcttgtttgggttgatgcaggattcacaaatcactattaaattgctgatgagtatatgtgatccaaatgtatacgaggttattcataagagaacaacctgcctaactgactggataattgctactgtaaggtctgtttactctggaaatgggacttcccaaccatccctataaaatgccaagtggagcaccccagataatgtagttgatatgcttcatatgcaagccatgtgaaactgtctttataactgggatattctcccattgaatatgactagtatccagttcagtgccctgtaacctctcccctcccctttgctcactgtcctggagtggcactggcctctgaagtaattcttttttggtcttgggactagttmaggggaaactgggtgggggaaatccctcctgccctaagtgcagttggactgtacagaatactccaaaggccaatggtagttcagcacagaaagagggaaggcctccaagtcagaaagagctccagagacctcatggtattgtagggcagggtggtgggccaaggttaggacactgcataaaacaggcaatcccaccacctctacctgctcacgccaggagaatccataactgcctagaggcctgagacccctacaagtagtaaggtgaataggcatctatycagcctagcagtaggattgatgtctgtccagcctggaagaggggcactaggtgactccctccccttctgttgtaaatactataattatcagataatttaagttattctcatttgtaactgcatttctggttcaggccagagtcatttggtatttaaaaaaaagactgagtcctttccccatttctcttctctttcccatagattcctccacctttcaaactgttttgtatctatttcaaaggaagatatccctgagactgggtaatttataaagaaaaaggggtttaatggactcacagttccacatggttggggaggcctcacaattacgacggaaggtaaaggaggagcaaaggcatatcttacacggtggcaggcaagagagcatgtgcaggggaactgccttttataaaaccattagagcttgtgagacttattcactatcatgagaaaaacacagaaaaactcacccccatgtttcaattacctcccacaagttccctcccatgacacatggggattatgggagctacaattaaagatgagattttggtggggacacagcccaaccatataattctgcccatggctgctgccaaatctcatgtccgcacatttcaaaaccaatcatgccttcgcaacagtcccccaaagtcttaactcatttcagtattaacccaaaagtcctaacttaggagccakcaaaaaaaatcaaaagcaagttagttacttcctagatacaatggggatacaggcattgagtaaataaacccattccaaatgtgaaaaattaaccaaaatgaagaagatggaggccccatgcaagtttgaaatccagtgagcagtcaaaccttaaagctccaaaatgatctcctttgactgcgtgtctcacatccaggtcacactgatgcaagaggtgggttcccatggacttgggaagatccacccctgggactttgcagggtacagtgcccctctcctggctgctttcatgggatggtgttgagtgttctgtggcttttccaagtgcatggttcaagttgttgatggatctaccattctgggatctggaggatggtggccctcttctcacagctccaccaggcagttccccagtggagactctgtgtgggggcttcaaccctacrtttcccttccacactgccctagcagaggttctccatgagggtcctgcctctgcagcatacctctgcctggacatccaggtgtttccatacatcctctgaaatctaggcagaggttcccaaacctcaattctttacttttatgcacctgcaggcccaaccaaagcttgagacttgcaccctctgaagcagtggcctgagtgtacattggctccttctgggtcccatggctgggacccagagcaccaagtccaaagactggacaagaaaaccattttttttcctcctaggcctctgggcctgtgatgggaggggctactgtggagacttctgacatgtccgggagacattttccccattgtctrggtgattaacatttggcttctcattacttacgcaagtttctgcagccatcttgaatttctcctcagaaaatgggtttttccttttttatcacatcatcagtctccaaattttcctaactttcatgctttgcttcccttttaaacataagttycaatttcaaaccatatctttgtgaattaataaaactkaatgctcttaagagcacccaagtcasttcttgaaagctttagtttgaaatttcttccaccagataccttaaattatgtctcttaagttcaaagttccactgatctctagtgcaggggcaaaatgctgccagtctttttactaaagcatagcaagaatcacctttgctccagttcccaataagttcctcatctccatctgagaacacctcagtctggactttattgtccatatcattatcagcattttggtcaaagccattcaacaagtctctaggaagtttcaaactttcccacatcttcctgtcttccgagcccttcaagcctgtaggaagctccaaactttcctacattttcctattttcttctgagccctccacactgttctaacctctgcctgttacccagttccaaagtcatttccacatttttgggtatctttacagcagcactccactctctgtaccaatttactgcattagtccatttcatactgctgtgaaaaaatacctgagactgggtaatttataaagaaaaagaggtttaatgaactcacagttccacatggctggggaagcctcacagtcatgatggaagatgcaggaggagcaaaggcatgtcttacatggtggcaagagagcatgtgccagggaactgccctttataaaaccatcagatcttgtgagacttattcactatcacagaacagcatgggaaaacccacccctatgatccaattacttcccagtgggtccctctcacagcatgtggggattatgggagctactattcaagawgagattttggtggggacacagccaaaccatatcacatggtaaatttggaggttaagtgctacatgggcactccaggtgacattactaccacagaatcacagactgatcaaatttgctgtcctcatgggtyttacagatgcttaataaaacaytggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgtkaattggacacactaaatggaaactagtaagattgcctgagcctacacaatgtagggtagaagctgaagggctagtagggacaaattctccacttcatatccatttgtggagcatttattagggcttatggtaaaagactgggagcacttcccratgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccgtgagtattctggttttatgacaatatagttatttgcataagtttagtaagagtcttttgttttawaacaggacaattggagacactgattattttaccaagtctttgactagaataacatatttgcaggtaaatttccagcaaagccaacttaaaaagagcctatatggtcagtcaatttcttgctgcactttatgcaaataatcaggccaagtataataagcctaaaacttatttttacacacaaactggtcttactataatttctctttaatagaaaaggagggctagagagagagaaaaattgtttcaaaggaaaaatttaacacttgttactggatttcagccctgacttttgtttttgaatgcagattgaatcatgaattatttcttggctataataatcctctaaagagatagcggattatagtttttctttacatttttagttgaatccctaatgagatagcttccattttccattctgacacacamatactcttttgattgtcaaaatattaatgttatttatctctccttggttyacttccaaggaaactggaatgatggtattctcaagactagagatgcaaatctctctcatttgtcatcccactgagcccgatctgtttttcactgcaaatgcccttctgttaagactatacaagcaccctccctctaggcctaaggactgttgtggaagaggtgggtgtgtgagattgtaagggctaggtttgaggaagtgaattagttcagatcatycaaaccaaggatgggtacacgatgcctaaacagctggtaaaacaaagttttttgccctctgagctattatgaggcatcttttcatccagcccaaccatgaagaatgtcatgctatttgtagaattaaaagaaaataactactgagaggataaagataccttgtgacaaagccttctggatataagactcccagttatgagctgtgcagatagatagatatgtatttttaaagtttattttcatttatttatttctttttttgagactcactcagggtcttactctgtcacccaggctggagtgtagtggtgccatcaaggcttactgcagccttgaccttctgggctcaggtgatcttcacacctcagcctcccaggtagctggcactacaggcatgcaccaccatacctggctagctttttgtctttttgtatttttttagagacagggttttgccatattgcccaggctggtctcaaactcctgggctcaagccatgaacacaccttggccttccaaaatcctgggaatatagatgtgagccacggtgcctggtcagtatatattaaaaaattatttttcagagcaatgcttatgttttgtgtagctaattgctataagtccataactaaaaccaagattatagtagctcwatgcatagaagttaaagataagtcagttttgtaacctggcctttggctttctgtttgttgactttttactgaaaaaaatttaaggggtaatgaatacttgtccatgtccattcctatctggcctagaacatttaatttgctataagtcttttgactctaagtaccttggccatagggggtcccactgagggacagggtggatctcaagcaggcagccatgccacccccacaatggtatgagacaaaataaaaatttggtagacattgctgttgcctctggcaaatcttaggtggaagagggagaatgtaaagcaaaaataaaattctgaggaccccaaccatctgaatggacccttcctctcagccaaaggcattccaaaattaacctgaaaagcaagtttaggccatgatgggaaggaggggtgggccagacatgcctcattgtaccctcttcccttttggaattcaggaaaaaaccaaccagaactaacatcaacacagactttaagtctgacaagaaacatttacatctgttgtttctgaagcctgctacctagaggctttatccgcatgatagaaccttggtccccacaagcccttattataacccagatattattttctattgataataactcttccaaccaattgccaatcagcacattttaaaactttaaaactacctatgacygggaaccccctgcttcgggttgtcctgcccttccagattaaaccaatgtaaatcttacatgtactgactgacgtattatgtctctctaaaatgtataaaagcaagctgtgccctgaccatcttgggcacatgttgtcaggacctcctgaggctgtgttatggccacatccttaaccctggcaaaataaactttctaaattgattgagaactgtctcagatacttttgggttcacaggcatcagccaacccaaatttgttagtgccttgctcttggactttccagtctttggaactatgagaattacatttctgttgtttataagccactcggcttagggtattttgttgtagcagcccagatggatgaaaacagtatatttaatcttatttgattttattttactttcagctctgatttcttcaagatgtttttgatacttattctgtcattaattcartaaacttgtattgggtgcctgctatttgtcaggcacttagtaggcaccagggccacaggggtaaataacatatggctcctgtatctgacttgctctcagaataatgagagaggaacttatagacatctaaatccataaataaagtacactgtaatagaggttgtaatcaagttaggcacacagtagggtgggaagataaagaatgaatgaatggttagggcttacctggggagcacagaggcaaaagaggcctcacaatggaagtaataaaatacctgagtcttgagaatgaattatatattgaccaggtgaacaaagggaagaaaggcattaaaactggaggaatattatacaaaagcactgacctataaaatggcagggttaattaacacagctacatgtagaacactgtgtctaagracaagcaacaggagatgatactgaaatayagatgaggctttgtttaccatcttaaaaatcagagatttttgtttatgggaattactgaaaagttttaagaagtaaaatttgctaactatgtattttattaatttatttgacaaaaaattatgatccaaattagtggaggtggcgtgtgaaagagaggttggaggtagacaaggctagaggagagtaaacaggatttcaattgtctragctaaactgttcatacatatgagaggtttcatcatacgtgtggtagttaaaagcatggatgagcatgaacttcctaaagacagcatgcatagcaaaagggtagggagtacaagacagaggcctgaaagggttgaccaaagaagagagaaagaatcgagcagttagtcagagatataggtatgcatgggggagggaatttcaggaagaaaagagagatcaatagtatcaaatgactgagagtcacgaagtaagatggtaattcagacatagcttgtggatttgggatatttgggaatcaggaagttgtttatgaccttttatggaggtagtttcaagaaacaccagcctgtagcagactatagggtggatggaaggttaaacagtctagagtctagaccattcttctaaacagctttgtggtagctagagtagctaaccatcaaggctgagggaaggtgttttgttttgtttcatttygtttttttctcaaaaggcaagaaatgccttggatatattaataagctagtggggaaacaagcaataaagggtgtgaggttgaaaatagagagaaaagcctgggcatggtggctcatgcttttaattccagtactttgggaggccaaggtgggcggatcacctgaggtcaggagttcgagaccagcctggccaacatggtgaaaccccgtctgtactaaaaatacaaaagctaaccggtcatggtggtacacacttgtagccccagctacttgggagcctgaggtgggaaaattgcttgaacccaggaggtggaggttgcagtgagccaagattatgccactgcactccagcctgggtgacagagtaagactctgtctcaaacaaaacaaaacaacacaaaacaaaacaaaaaagagagagagagaaaagagcaataacggatgaattagaatctcgaaaatgggaagaatggattcaagagcaagattggagggattttatgtacaggaaagggacaccaatctttctaaagacataggcaaattagagaaggtagggatagaggtaagtttgcaggtgaagttgctgatatcatttgctgatcatgaagagagagaatgtggctgggttggagactgagaaacagaaaaggttgtgagttaacttgaaaggaatatgtgaggtagaaaataagttgtgtgattggctcaagactggaggtgtggaaggtggaaggtgtgagaattttaagaatttgagtgtgctaggtaaatagtaggtcaaatggtctcccaggttgcaagtgtcatcagaaactgtcttcaataggaccaagcaaaaatctctatggcatgtgactgaagaccaccattcaagttgatgtaaatctatctataatttgttcattttgaagcagtaattaatctacctaactatactattaccagtatacagtgctcctgttttaaaacctcttactaaaagctatctttttaaatttaattttaaaatatgaattttaacttttcatattttcagtaaaaccatagtagctcctggtgatcacagtggttctatctgtgaactcatccctgatgttgttatggattgcatcaacctcactgtttcctggaactataccaataataggaagtatgattgataaaacctatggaaatttatagtatatatattaggcargcagtaaggataaacagaagccaatggtccaggtgagctgattctccaaggttcaggaaagcttcccaaaataaatggagtctcatttttgtgtggtcctccatttacactgcagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaaggtaatctggggacctattgtcctgcagagagaacttaagtatatttgctaccgaaataatgtctttgtataattctgcattctttcttttcattacagtacatgtatgaattcttttgtactttagatatcattgtagctctgaagacatgtttaagttatcagctatgtattacttagaatgactgtttgtttctatgtatgtaccagtatgttatacaatattgaggctgcaactgcctacaaaattagtctcactttgagttttcagagagaaatcacagtatgacagacaaaaggagcagactacactttacagtttcttgcaaattcaaaggttacttaagttggagacaatsagtcttatggtggaaggcattttgtcaacagacggcaagtatacaatttaaaaatawttttttctacgttttcttatatttttttcctagatgtttctgttggcaataacatgtgcatttgtatccaaaacactgtctggatcttatatgaattccatgctcacacaaatagagagacaattcaacatcccaacatctctagttggattcattaatggaagctttgagattggtaatgaattatttttgcatttcttctttttgtattttgtcttatctgtggagctagtctgaattttattctccttatttgctgttttaggtcatttaatctgaccgagttataagttttctaaaactaactgattagctaagcttagaatatgcttggaaataattcatttaaatattacctcatattaacacctamatattgccacatatcctaccattgttctttttattctaatagtttcttagttatgtagcatgagtagcagagtatttacagtatttatatttaaatatcatttgataaccctaagggatactaagggttccatctttgtatttagaagatacaaaggtagaagaccgccgggcgaggtggctcatgcctgtactcccagcactttgggaggcggagatgggtggatcacgaggtcaggagatcgagaccatcctggctaacatggtgaaaccccgtctctgctagaaatacaaacaaattggccgggtatggtggcgggcgcctgtagtcccagctacttgggaggctgaagcaggagaatggtgtgaacccgagaggcggagcttgcagtgagctgagattgccactgcactccagcctgggtgagagtgagactccatctcaaaaaaaaaaaagaaaaggtagaagacctagaagatgtagaagatattgttggagatcaaggaaattgccttacaaatgaaaatgcaaatatttttctgctatttggtctgggaggttgacaatttttttttctaagtacagagagaagaaaagactgcttttatagctctctgaattcatttcagaggcagcctctagagaaaaataaagtctactcatagattctgatttttgtggatgactgggaatatgtgaccatagagagggagaatgggggaaaggaagatttcttccatgaaaaaagttatatagaaatataagtgtcactcctttctagttttataatagcttccactttcttcaaggtgataatttcctttaatataaatgtatttaaaaaatcaggattgaggagaagcaaaactgaaacaagtgattcttgatcttgtctactagtgttcaactcctttagatcttagcctgtatcacctgtgtgctgatcccagtgagagagttagaactaactccatgtatagcccacgaattgactcagctcataatctaacggaaggtagagatgcagataataatagtattaattgaatgaagtaagtttggtagcatagatatatacaaggtcttacagggacagaagaaacacagactcatttagggaagccagactctcggaggatagctaaaattttctaggagaagaaatgaggttaagcaagtgtgaagaaaattccagtagaaaaagcctaagaaggatgcagygcaatagcctatgtgagaagcaacattcagcttgataatattggctagccaagataaagttggaaaggattaggaatgtgagcctgcagaaatgggcaggggtgagaaatgggttaatgagagctttgtgtgcctgctatggcatttactttttaattttctaggtgagggagtgtcactgaggattggaagggattattaacctttctgtgcccaggacccttttagcattctaacaccatatgatcccggagtaataattttaattgcataaaaaaaactatatgggtgcaaaggaagccaattatattgaagtagaattatcaaaatattaaaacaaatttttatatagtartatttgtacttttaatcaacccattaaattaaaaagttactaattttaaagtaattattgtgtcaatgttttgaattgtttgcaacagccatattgtcatctgaacatatctgtaacttctattggtgacaattggtgacaaagttatatgttcacattgcagtcatgtgagtctgaagcactggggaactatctgggctggagctattgattagcaagtaagtaggcgtttgctaaaactagagagagaatttatgaggttattcagggagaggatatagggtgataattacaatggacaaagaatagatcttgagctgcacaaacatttaaggcacaggtagaagaaaaggagtctatgttaagagaaggaatggtcagagaaacaagagggggaactaggagaaaatggtattatgaaaaacaaaggagtagaaatttgaaaaaaaaaaaaagtatcagcagtgtgaaaagcattagaaatatccagttagacaaggatgaagaactattccctgggtttcataatatggagataactgatgatctttgccagggcactaacaaatttagacgctaggaagcagtgaaggtaggagcgacgataggggattagggaggggggaaaagcggaatctatgaatatggatgaatgttctgggaagtttggagagaaactagagaatatgtgtaggctaaagtctagttgagagagagaggcttaaaatacatatgagagattttaattactagagtaagtggctgaagaaaatggcagtgccctggtgatgtgtttagtgttgggtggtcagatgggcaccacaacttctcaaactgaaggaacgtggtaaggccatcaggtggaaaactcaaatgccttcatgtttgattgccccaaatttcttgataaagtagaatatattaacaatttctaccactagtgggtggtgataggtagcttgaggagaatgatgattagaaatagtgtgaaatttacaaaaggcaataaacatatcacttagcttatatttccccagtcagttttacaggcaacattctccatacctttgaaaaaaattacttaccttttcccatgctttctcattgcaattatttcctgacagagcaaggcagtttaaaacatgaactcactcttacgtgaagaaggaaagttcttcctttcttctcctttcaaaaaacagatatggatttcaaacaatggcctctggagacactacctgtaacacggatgggcttggtgatgagattttagaaaactagagaggtcaatgtggctgatatagttattgcggtggggcgctctccatataaaataatggacaaatggacatatcttctacacacaaggcagactagagaaaaatacaggtggaaagaaaacttttcaaaatatacaccacttagaaaattattaactccttgaggaaaaaaaattttgaaatttttataatcttgagtcattgcagaggcattctttatatatagtgggggcaaggtagatattatttactgaattaaaaatgtatggtttgcaaaaaacttaytcgtatatttgtttttttcaaatctttattccacactcttcaaggatctgtccatcagatgggccttcccccattagtttctttattctaaagcttcgtcctaagacatgcggatacatttttcattgccatttttattcctcaaatccagactcactgaagactgagtagaagtgggggtctactaatttttacttcactgcattgtctgatctagggaaagaagtagaaaaaaaatagatccctgtcttggtcatgttgaccaaaatgaagatatttttaaacaatgagttacaaaacattcagctacctaaatttgacttttgcttctctttctgggcataggaaaacatgataatgttctgtggagtaggcattgagagagaggccagaggtcacatgcaggctgacaccttcttttgaacctcatttcccaagtctagatagtcacaaatagagccttccaaatttcccagaaccattctttagtccctttcaccggcttctcttcttctcccctctgtaaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaaktaagactttgttcatactttttaaaatgattattctcaattttttcctaggaaatcttttgttgattatatttgtgagttattttggaaccaaactgcatagacctataatgattggcattggatgtgtggttatgggcttaggctgtttcttaaaatcactacctcatttcctcatgaaccagtaagtactccagtctgataattttgggtggtcaaatttcacttgcaggaaatgaagttgcacttycctctctaggagcaatgctttcyaacagcatagggcactgtaatgggaaggggaagatgcacattctgttyyatctgtctatttggtgctcttggctgcctcacttccacttaagcagtcagttttgtcaatttacacratggggatttgggaccttttcttgtggagttgagtctggtgaaaagattctcaggaccagcccaaacttgggattattcccttctcaggaccatgtaaatacttctaattaataatgagattctgcttaattgcagatcaccaagagacagagcagtctgaaggctgatttttcttttaatttttaccaaagtaactatgtacaaagtcataaaaataaaaactattacaaaaaagcttacattgacaaaaagktctcccttgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggttcaagcaactctcctgtctcaagcctcctgagtagctgggactacaggtaccatgcctggctaattttttgcatttttagtagagacggggtttcactgtgttagccaggatggtctcgatytcctaacctcgtgacccgcccgcctcggcctctgtttttatttttgttgagacagtctcactcactctgtcgcccaggctggagtgcagtggcgccatctcccggttcactgaaacctctgcctcctgggtcaagtgattctcctgcctcagcctcccgagtagctgggattataggtgcatgccactacactcagttaatttttgtatttttagtagagatggggtttccccaagttggccaggctggtctggaacccctgggttcaagcaatccgcccacctcggcctctcaaagtgcgggattacaggcatgagccacctggccmagccttgcctctgtatttctaactaaatgttattctattagttttgaatcctggcataccctgctttactgcatttcactttattgcactttgcagatattrcatttctcacaaattgwaggtttattgcaaccctrcgttgaagattagaatcatttttccaacagcatgtgctcactttgtgtctgggtcatatttgataattattgcaatatttcaaacttttgcattatttttgtatctgttatggcratctgtgattagtgatcattgatattactaatgtaattgttttgatgtgccactaacttatgcccatttaagatggtgatttatttatttatgtatttctttttagagatacagtgacgcccaaggtggggtgtagtggtgcgatctcactcactgtagctttgacctccacaggctcaggtgatcctctcacttcagcctctccagtggctgaaactacaggcatgtgccactatgcctggctaatttttgtatatatatatwtttttttggtagagacaggatttcaccatattgccctggctggtcctgaactcctgggttcaagcaatgcgcctgcctcagactctcaaaatgttgggattacaggtgtgagccaccgtgctggtcttaagatggtgaatgtaatcaacaaatgttgtgtgtgttctgactgctccactgaccagccattgccccattttttgccctttccttgggcccccttattcccctagatacaaaaatattgaaattaggccaattattataataaccctattgtggccttcaggtgttgaagtgaaagaaagagttgcacatttctcactttaaatcaaaagctagaaatcattaagctcagcgaggagggcaagttgaaattcaraataggcccaaagctaagccacttgcaccaaatagccaagctgtgaacacaaggaaaaagtgctatttcaaggaagacacaaatgattagaaagtgaaacagtgttattgctgagatggagaaagtttgagtagtctgaacagaagattaagccagccacaacattcccttgagccagaagagcaagactctctcttctattctacgaaagttaagagagattaggaagctgcagaaggaaatttttaagccaagagaggtgggttcatgaggtttaaggaaagaagctgtctttataacataaaagtgcaaggtgaagcagcaagtgctgatggagaagctgcagcaagttatccagaagatctagctaagttaattgatgaaggtggctacactaaataacagattttcaatgtggatgaaacagccttcttcttcttctccttcctcctcctcctcttcttcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctcagctcactgcaacctttgactcctgggttgaagcaattctcctgcctcagcctcccaagtagctgggatcacaggcacctaccaccacgcccagttaatttttgtattttttgtagtgacggagtttcaccatgttggtcaggctggtctcaaacttcagacctcaggtgatctgtctgcctcggcctcccgaagtggaaacagccttcttttgaaagaagatgccatctcggactttcagagatagggaggagaagtcttttcaaaatattactgctaattgacaatgcatctagttgcccaggagctctgatggagatgtacatggagatgaatgttgttttcatgcctgctaacacaacatccattgtgtggccacaaatcaggagtaacttggactttcaagtcttattatgtaagacacacagtttgtaaggatattgctgttayaaatagtgattcttctgatggatctaagtaacataaattgaaaaccttctcraaagaattcactattctacattccactaggaaaaggagaggagggcaaaatctcaacattaacaggaattttgaaaagttgactcaaatcctcttagataaccctgaggggttcaagatttcagtgaacaaagtcacaagactttagtggaggaagtcactgcagatgtggaaagagaaagagaactagaatttaagatggaacctgaagatgtgacttaattgctgcaatctcataataaarcttgaataaatgaagactttctgtttatggacaagcaaataatgtggcttcctgtgatggaatctactactgatgaagagcctgtgaaaactgttgaaatgacaactaatgttttagaacattacacaaagttaggtgataaggcagcagtagggcttgcaaggattgactccaattttggaagaagttctactgtgggtaaaatgctatcaaacagcattatgtgcggctgggcgcggtggctcacgcctataatcctagcactttgaaaggccaaggcgggcggatcacgaggtcaggagatcaagaccatcctggctaacacggtgaaaccccgtctctactaaaaacacaaaaaaatgagccaggcgtggtggttggcacctgtagtcccagctactcaggaggctgaggcaggagaatggcgtgaacccgggaggcagagcttgcagtgcgccgagatcgtgccacttgcactccagcctgggcgacatagcgagactccgtctcaaaaacaaacaacaacaacacaacagcattatgtgctacagaaaaaacttttgtgaaaggaagagtcaattgccrcaggaaacttcatcactgtcttattttaagaaatttccacagcccccacaaccttcagcagccgctaccctgatcagccagcagccatcagcgtggaggctaaagcctctaccagcagaagatgatgactcgctgaaggctcagatgattgttagcatcttttagcaataaaacattttcaattactgtgtgtacattgtgtttcagacataatgctattgcacacttaataggctacaatatagtgcaaacataacttttatatgcattagaaaattaaaaaaattcatgtgagttgctttattgtgttattcactttattgtggcaatctggaaccaaacgtgcaatgtctctgagatatgtctatacattagtgttacacaatatgtattgaattcctactataaaatcatttttactatttacatttgtataattatgtaaatcttttttaccactgaaccatgcgcttatcattctttacttatataactttttattttccctagatttaataattacctcgttatatcatatggttagctttctttgtattgttcacgaattcatcaccaaattctccactggtagggcaaatgtctcctcaatattcttatccatatcacagtgtattatttttgtcttggagattcctcacatatcactttcaattctccatctgcaatctgaacttggaattctctaggcctgctgcattgctatttycttggaattttctctcatyattatccttgagaatttgctttttacctgtttcatacattcagttattcattttctgggatgtcatgtctcctgctttcctctttcctcttcacttgtttttgtgaaggaaataatctagtagctttccaagaaagtatacaagagaaatataaaatgtaagactttgtatatctgaaaatactcctattttactcccatatttgattgttactttggcttggataaaattctagattggaaatattttccctagggattttgaagacatttcccccaatgttttctagctctatctaacacttgtaatcaagtgttattattcagaatcctatgccgttctaatctctgtgatcagttttctttcagtggaaactattggaattttcttttaagctccaagtccaaaattcatgataattgtcttggtataaatctgtctcctccattgtgccaggagccttcaatctggacatttggaaaagttacttttgttatttctttgataatatctcccctataccttctttcataacactgttttctctttctagatctctattacttgaatattggacatcctgtattaaccttatgtttttctcatcttttatccctacttttttgtcctcttgtcttcttgttactttctgggagatttaactttattttccatgcctttgaatggctttctagcttatgctaccacatttttaattttcaagggctcttattctttgaatgtccctttttaaggaacatactattctttcaagaatgcattatctcttcccatctaaattttgttcatctttcttcttggtctctggctcctccaagtgtaccgtttttttatttgtttgtaactgtctttactgttacagacttctctcatatatctggtggttgtttgttatctattcacatttaagagggaggaataacaacaacaagaagccagctggaagttctgtaaatatgtgtaggacttggttaaaggaggacttctttgtagagtcattacgcagggactggctgtttcgcacatggctcagaattgcagataacctgttatcctagacaggaattcttcaatctgttccttgggaggtagaagcttagctaccagccaaatggaagttggaatctcactgtttaatatgtagatatgtagatttttttaacttaatacccccaatttttttgtattgcctttctatgctcagtgtgcctctccagactctggagtcaatgaacattttcagctggagtggcaggggatgtctctgggagttgaatgtttcttaaacaaactttaaaccaaaatgtttgcrctcttattgttttggatcatactcacttttgcatttaagtatcttgcctgaatgttcctgggctttgcagcattgcttccttgcaggcacttagagttgcacttctcatatcttttatttcagtgaccactcagttacctgcttttccattttgaaaatcttgttgagctctcttttattgtaaaattccctattttttttatccttgtggaatcatgcctttccccattctgtttgaaaatctatttaccgtcattttgctgatgctttgggaatgaatagactttgagttaytggatttttagtggataaattaacaaaacatattttctcttttaaagtatttttgaagggatcagagtttctaagcagagtctttccttttcttttatttcctagcctatccaaaacaatgtcaagtaatattcagccactgtatacatttctttctaccacctgccaaaggtgttatttccttgaggttgtcatgtctcataggattgtgagtatggagacagaagcctttgtctatagttcacagccaaactctttgggcatcaatgagcaattgttctaaggggaaggtattttgagcctttttattatatcctatagcacagaaattaagactatcagtggcatccaagcataacactctagcttttgtagaactcagaagggcaagttttcttctgactaccttatttaatagaaatacagaaaacaatccagcattatttctaacaaacagagacttcactgaacatactttgaacatactttttttcccatcttacggcatgtaatttactttctgaggaaaagcatgtggatcttgtggtaatttgcttaaattaaatggtcatagtttattaatccatttgttcttatgagaagagaaaaagtcattacattatgtgtcatggtgattgagattctcttaaggcctctcattatgatggacaaatattttggtttttttaggggtttatgaaacgcatggaggagttattgtacggtttctcagaaactggaggtttcgcttcttttgagyaaactttagagaatgccaagttgaaggcttgttttgttgttattccttccaaagcatttatcttcttaattatgcattattgaatgtcacattttttaaagtttgtgttccttatctcataataattatatccaggaaatgataacctaaaaatcaaagaaagttgatatttgataatctaaaggtagatcatccacaggcagattattgaaagctaagtataaaaagattgttcatttacagaaagtggcaagttttttgatgatattaacttatgataacttggatgccaaggatgaaaagccatttttactggatttggatattgtgttgtatgggaagcagaaggtaacaatctgcacattgcccacattgtcctcattactttcttaaaataaactcattttccctgtgtttatacagatatgaatatgaatctacagtttcagtttcaggcaacttgtcctcawacagtttcttgtgtatggaaaatggaacccagattttaagaccaacgcaggatccatcaggttgtctacttcattgtattgatttttgttcagcgaacttataactaaacactttctgctgaggggcttgaatgagatattgattgagttagayaaataaacaaagatatgttctctctccaggaacttccaaaggagttacaatgggcaataagaatagctaataataaagaatgttatttttcttatatttgaatgtatttattgagagttccttgtttatttattaacatgttatctaaaaatgagtcaaagggccgggtgcagtggctcacgcctgtaatcccagcactttgggaggctgagacggatggatcacctgaggtcaggagttcgagaccagcctggccaacatggtgaaaccccacctctattaaaaaatacaaaaattagccaagcatggtagcgggcacctgtaatcccagctactcaggaggccgaggctggaggatcgcttaaacccaggtggcrgaggttgcagtgatccaagattgcgccattgcactccagcctgggcaacagagtgagactctgtctcaaaaaaaaaaagagtcaaagacatctatccaaggaccactgttaagttcatcccacagaggaaaacatcttataaggatggatttatgctgatgatttggtgtatatgattatgtaaataggaactagagacagaaacaaagttcaagagatttgtgttctatcactgatctttaatagcggggaaaacaggcaagtacgctatagttctgaattactctattccctttctattgacttaggaacttgtctttctgctctttttttttccccctctactggagatagtgctttaaaattctacacaatagcagtgcttctttcagcttctggtagccctaggcaccaatgtactggcttctgccccttctgtcccttctgctaagagacttgtataatcttctggttatacttggtctggagatgactctgatgactcaacatttttatggggacatttttattctggattcatgttygtggaaattgcagtagtccacaagggtgggaatttcatgaccatcattgagtcaggaaaccaaaacagtttcaaaaatttgaaaaatgtctgtctcagaagaagccaaagaacccccatgggggaaacaaaggaaaacartgacattaatagtggcctgtgttctcttcctgagckggctattgccaaagactgacccaggtgctagtcggcttcattgtggatatagcaaaaccttcccattctggcacatctccaggaaggtggattgatgctttcaattttgccctagaataggcctagagtttgcctgtgatctctagacacaaatcactttgtgcatcacacaaacaaatctgaatacctagaaatagagactattattttccgactggaaataatggagagatagcactcacaagaaattcctggacccagctgtggtcaggacctcacagtctcacctggcaaatttataggaggtgagagtgcattgtccttcagatccctgaaaacgggactccacagagcttcctcacagcttaccagctattttggcttagaacatagatggcaaagagatttacagaatccttcagagatctccctatctttctcagtttctattccctttggtctagtctttgttactctactaagcagctgcggctccaaggattggagtggatttctgtattgaaagttatttggtggttacagtatacaacatgctctatagagaacctatgatgattacccaattaaatatttttagtttctatgaaataattagagctgtagagaattcacactttagcgaacttttgtttaaatcttataaatatagtaccaattctagagaaatatatttttgtctccccaaagttgggtaggaatggggaagcacttgtagcagctgaatgagtccaggagttgtggagaaactgaatctctttgatttttaatgtttgccaatttctgtggtgtaacactgctatgaaactaccaatgaggtgtcactgaacactgagttgggaggaggtgtgtatactcatctctcccaactcagtagggactggctccagcatatcacttacacttgtccatactcaagtccactgtcagaaaatgcactaggggtgccctgagaagtcactgctggaatagtaatataaatcattgacaaggggccatggtcatataactgtgaaatgcctacagaaaacatagaattaatattactgacactttatcgtcaaagcactaatgtcatgtcttttttttttaatgcagagtgtacaaaggaagttaaatcattaatgtgggtgtacgtcctagtaggcaatattgtacgtggaatgggtgamactcccatcctgcctttgggtatttcctatatagaagattttgccaaatttgaaaattctcctttatatattggtaagtatrgaaatctaccttagcttcttttcagggcaatatgttccttgaggttagaaattagttatatttttgtagtcttagtgatttccacaatgatgagtagagtrtcttggcacagttggccttccataaaagtttgttgaatggagatgagatatgctaaatgacaatgagctacttggttaataaatctactttctactattggaaataccacaagtctagtgcccctggaggtgaccctttcatctgcttggcactacactacatccaatctgttaagagatttgcaaatgttttctctaaaatgttctgtgcattcaaaacctttctcgctattttcactacctctgtttttgttgaggttctcattactttgtctgtagtttctctttattattttctcttcagaattytattttctcagtttttaagaaacattcttgcaatataatttttctcaagcattgttttaatcatgtcttctctactatatttatgacacatataagctcctcatttattaaatctgatctgtccacttattactcatggctctgcatgacattcacttacttagtttctatacagtttctcttcttaatgatctctccatatagtcaggcttcttcatatttttcacaaatacgtcttcatctttttgtttatgtttcttgaaattaccattttaaaatccatgtaggtcacctggaacaatagccaacttaagacccaccttcttgtgctgccttccaatctctgaaatattcttaatttattatgcacgacttgcttatattttttgttattctatcaatagttggtcataaactcataacgtttagtatagggacattttgccattaatgtatgtaggcatatcttttaaaaactaaaaaagtcaaagagggtgagagaagatggaaatgattacacataatccagatggatgaaaatattgagggatcattaacccaagtgacttttcacacattttggcaactcattaattttgcaataatctttttcagtgattttctattcagtccttttaacttccttcacaaacttatattaaaagaatgcaaacactctcctacaataaattaacaaacaccttgctatgacatctgtttctttattcaacaaatactatggtgtattatatgtaaatgtagctgtgataatctctatacatattaaaatraggatgatgtggtccatacaaggttagtaaataaagaactacataattattagtactatatatatgtagtgtgtatatatatgtatatacatatatagtgtgtgttcatgtgtgtatccataaccaaataactataaatcaaatagctctacaccaagaaaacagttccatatggctctggagtttagaagagaatataaaagctaggttaaaagttggaaaattgaccaggtgtggtggctcatgcctgtaatcccagcactttgggaggctgaggcggacaaatcatctgcagtcaggagttcgagaccagcctgatcaatatgatgaaaccccgtctctactaaaaacacaaaaattagccgagtgtggtggtatgcgcctgtaatcccagctactcaggaggctgaggcaggcagatcatctgagttcaggagttcgagaccagcctgtccaatatgataaaaccccatctctactaaaagtacaaaaattggccaggtgtggtggcatgtgcctataatcccagctactcagtaggctgagacaggagaatcacttgaacccgggaggtggatcacttgaacccgggaggtggaggttgcagtgagcactccagcctgagcaataagagtgaaactccatctcaaaaaaaaaaaaatggagaggtaataaatgaaatcaagagggagaaataaggttgctgtggaagaacatatatatactgagagatattaggataaaatactgggaaagacttttacttagtaaatagaataggagaaaggaaaatcaaagaaggaatagtcataagaacacaatgaaacaatacatgtatagtttaatgaaactctcaggaagaaatgtaaaaagaggagttggccagcaatgtcaaataacctagaaagctaggaagatgaagaccaaaaaaagacactaaattagtgacaaagagatcactggggctacctgagagtatttggaggagaatgtaaaaggatttgagtaaagtgagtgagaggtgaggaagtagaggcagagagtatagtgaaaggagagaaagcagggtggatttgagattttgtagaatcattggctayggggaaattgaacgcgcacaagagagggagtatttggtagagcaaaaccttagagaagatagaaggggttggaaccaagaagttaggtgtgtatagggcgggttctccaagaaccatggagaaggcagagataataggcaaagccaaattttgaagtgaacaggaagaaagttgaagaagctcgtgtctggattttcagagatcagggagggttcagcataggttctgaattgtagacaagtgatgagacagctgatgatgaaattttaatggataagaattcaagtgaagacagataggactgatggacatggaaaataaaactgtggaagtaaaggaaggagaacatgataaaatcaaagacttgtatcatataataataatgaggacatagccagaaggaagtttcaagttgcagatctgagagtgaaacttttttgaggaatgtgccatgagaaatccactataagatggtattrctttagaattcctcccaaaacatgcctgtgggatgaattaacaggaccttggttatatcacgacctagtcaatggcatgatcccagctgggaytgcctgtgctgttacagcaaatctctacctgtgacccagcatgaaagggaatttggaggccagggaaagtggctttaaattatgaggcttctttttcaacatttacagaaacaaccatcatttatatgtacatcaagcttaacttcatataaattgtgtatctagtcaaaagtatccaaggcaaaaatattcaatcttcaggcttttcatagacctagaactctttatgtgggcatataactgtactataaccttatacttttatttatttttagggcttgtagaaacaggagctattattggtcctttgattggacttttgttggcatcattctgtgcaaatgtttatgttgacactggatttgtgaacacaggtaattcaataaaatctatttgtacagtgtctagactatacaaagcatctcaggtatgttatcatatataatcatggccttacttgaccttcaatttgataaatgatctctactttaaaagtgagaaactctagtggaggaatttaaataacttttaaaatattccaaaccagaaagcagtagtgcaaaataaaatgctaatctgacacagaatcacatgctatttctagtgcacttcaactatatttcttggttttacaaaatttaagcatgtaggtttgaatttatttcaattaagcaatcatttgttgatgatgaaatagaactttaagcaatcatttgttgatgatgaaatagaacttgtagctgtttagttaatacctgcttttaaatcccttacatgatagacagataaccagcctaatttattactagacaatattacaacaccacatattattagaaaaattttatcagtgtctgaattataagccaattttatagttggttgggacccgataattctaattttaataattttctatagttcatacagaaaatactgacttaagctaataacagtgtgtgtatttttttacagatgatctgatcataactcccactgacactcgttgggtyggtgcatggtggtttggctttctgatttgtgcaggagttaaygtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaaggcaaatatacatattctaaatactatgaaattgaccttttatttcatatagatatgtctgtattttagtctaacactatgatatgctatgctgtgttgagacaatttgtcatcaacagtcaccagtcaagaatacctaactagtccgattcttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatatctacacacatatatacacatatatatgtacacacacacatatatatatgagagagaggagagagagggtcatgtatatatatacacacacgtatatatatatatacacgtatatatatatacacacamgtatatatatatacacgtatatatatacacatatatgtgtgtgtatatgtgtgtgtgtatatatatacgtgtgtgtrkatatatatatatatatatwcacacrtatatatatggtcccatttgctcaaaaaaccgattttacagagaacataggttgaattgaaacaaaatgaacaagcaaatttaaactaagaacaaaagtaggaaaaagtatactctaatcttaataggtagtatagttttgtaaccagtgtgttagtttaacgaagagcttcctggaagttaaatcagaaagaaaaaaaaaaacatgatcggtgacccacctctctatacttggtagagggaagaataataatttttaaacagaagcagttctccaaggaagaaattgtaaaaaaatttaaaaatgatcataagatacatgatacaggtaatattgagccacatagtggttttccagcaaatgaaagggtaaattgcatgtaacattttttttggtacagaacctcaataaaagctcaaagtataatttacagaaggtttttctgtgggaaactaaactaagatagcctaagtatttagtactcaagagcactgatgctcaaacttggctgcacattggaatcacctaggaaattttaaaaatgattgatgcctgaaagttctgtagtattcccaaaaggtcagatttaattagtgtggatgtgcagcctggctattggaacttaaaaatgtttatttgacggatggtgagggtctcagttttctgtcaaatggggataataatagtacttactatagaattgttgtgtgaaggtaaaagacattctagcacacattattattaatactgatactagtgttagtacttttatgttgtcattgttgtttctatcatcacccataagttacaatgtcaatttgcatagaatttttcttaacaattgtaaattctcttaaatcataattgagcataatttaatacatctttggtcattaggagccaactcagaatcttgcaaattctcagaatcattctgatgatattaaaaactcttcttaaaggattgttatggactgatagacctcttgcagtctgcaagatcagttccattttcaaaattaggaaagagcttagcttgttgcaagacatagaaaagaaacttgtgctactgaaactcatctattaggacagggatgtcaacaaacatgggtgacttaaaaatcttcagataactctctctcctgtcaggtaccctattcataaatataaattttacaattataactcatttacttgmattaatctgtgtgtcctcctcttctaaattgtttatttattgaaattttgttccagaatgaattgtgagcagtttattaagcaaaccaagattgtgcataagaaagtcaagacagagaacatgtggacaggaaaagtgaaaggaaattaaaagtgagaacttgagcctgaatggtagcagtgtgaccaagaacatttactagaagcaggccacacattactagaggcaggccacacattactagaagcaggccamacattactagaggcaggccacacatttggctctgtgctttttctaacaggaatcatttttgattamatcatttacatagtccttagaatgtaccaaatgaatcagcatctctgaggrtgggacctggatgttggtattttaaaaaatatctccaggtagatcttgctgagaaccaatggcagaaccactgaaactgttgttctgaagaagcaaaaaaraattccggatacttgagaacattcatatctcattaattcccacacatctttatttcaaatgttcagggagtgataaaataaatatttgtgtgaaatcttctttatcaactygattttcctccagactttacagaacagaacaagcatctttcattctaatgagctgtagaaaaaagaatatattaatagaagaacaaaaggttagtaataaaatgctgtggacgtagacaatattttggtcactttgtagttttgcttactgatctttaagactcaacagtgacttattgagggcaaaactgttgtgttctgatccctacccagtcagctayatcactgacttccagaagccaccaaaacattgctatgacttcagctttcaaggggaaaaaagaattagcaaacaatacatattacaaaatagtaaaaaacataatttgttgaggaggtggatgtttcaggaaaagccagtcacaaaatgcaaagccaagttcgtttgacacagttgtcattctttcatttcagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatgtttgtttttctctgccttactagcacactttcccccccacgaacagtgtgatggcgggtgtagcaaactcctaagttgaagtsttttaggatattttttgactctggtggatttcttccttctaatctcaagaaagaaagaaagaaagagaaagaaagaaagaaagaaggaaggaaagaaggaaggaaagaaggaaagaaagaaagggtagggaagggaagaggtcagaaataccttgattttcttctctctgaagtcagaatgtgaattcataatatgaatgcaaatatttgggagtgcaaaaattacatattttcagataggattgtgcattttactaccaaattttactctttttggttccagttcaaggattctatgttcctcctaatttaattttttggtccccctagtggttttaggtgtctctgcagccacacacattcgrcttttcctgcaaccacactaacctcagtggttttagcctaacttgggtttttcctgggatctttccactgtttttaaaagtcaatatcccaggctacttgtatccacactacctaaagtgcttgtgaaagcttcaaatacctggggttccccctcagacacactgaatcagactctagggcgtggggctctggaatggatttttaacaagctctctcaataatatgattcggggagccagatgctcacattgtatagatggaacctagggctatcttctcctttttctattcttttttttcacttattgggaagggttcagagaggaagagccagtagcagcaagacatgaaatgtaaatacacttgacagcaacaggctcagcaaagtgactctctaaagtaccttgaactgggtgtggtggctcatgcctttaattccagcactttgggatgctgaggagtgaggatcacttgaggccaggagttcaagaccagcctggacaacatagcaagactttgtctctgcaatttttgtttttaaattagccaggtgtggtgktgtgcacctgtagtcccagctacttagagggctgaggtgggagcatctcttaagcccaggaagctgaggctccagtcagctatgatcatatcactgcactccagcctgggcaataaagcaagattctgtctctaaaaaaagaaaagaaaaagcactttgagaggagtctaattcttcacaaccaaagtgaggataggtaactgaaaaattgtatatatatattctcactacacagaatagagggtaataaatgaataaattactggccaattttgacttgccacttctacctggatcctaagaaaagagatttttatcatgatctctgcctataagaaattcacaagctactgcaatgagttaaatgaatgataatataataacaagagtctcccaaaatatacttccccattatgggggcatttcaaaatctccctgtgggtaatgtgtaactaagtggggataaaattaaatcattcttcttcactatgagttggacctaaatagttacttatataaggcatattacataaaagtgataacatatttgttccttyggtaagtcattttgtaaataatatttyatttgcatttataggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaagggtatgttgttttctaatgaatgtgagaatctttcaacaaatggttaatatgatattttttacaatggcaatgcacgatcagatcattttcttattggagttaatgatagtaatccatgcttttcctgtatctttcctccatctgtcaatcaagccaatctatccaagctctaggcttattaatgaggttgggaacatatcacagggtgagtgaatttatgattgtatgtgcatgtgggtgtgtgtgcatgattgtctttgtgatatccgagtagacattatcctatgaaagaaactacctacagtttcaggttgtattaaaatatgttatccatatatcttatactcccataactgagtaaaactaagagttgattatacagtcaaaatggcctttatatgtttccccaatgggcttaagtttggcataactaaatcataatacatgataaattaattaatacataattcatatatttcatttatattgctatgtctaaaatattgaatcatttcatattttgtattttaaaggttatctgggttttactgaaatgttttccatagtgatgtacattaaaagaattcacctgtagggcgtattttgacaatcaagctatcagttaaaatgaaataaagaacatcctaaaatgttttttcaaaattatcaaggtttattagattgaaataatttcaaatgtaaaatagtaatataattttacatatgctatttgatttgagactcatgagcttcatctaagataagcattattatctccactttacagattaaattgagattcagagaaatttaatgataaaagcagttcatttcaaatctcttcaactacatcaatatagaaatggattttaaaattggaataaattttaaagattgcctccatctccaatgatgctgattcccagacagaatgtgtagaaagtcgcactgtgatctagtctgaatgcagtctctaaactgctatgcaagtgctctttcaatcatattacaagcactggtcactttttatattagtagaatgcacttctttaattcaaatacctatgtttctggagctaaatgtattatctatattacaaatggaactttcagatttttatcttcatgctagtcctgtcttgctatttgctacctaatggatgaatcacagagattagttcatcttcatctttcgagatctaatagtatgtgaaaacatgactccacatggtaggtgctcaattaatgcttgtttattgcctatatattcttctgagataaatcattgaaggagtggctatgtggtcatcaaagcaggtctcttttataccaaagctatagtaaacaggtcacacattgatgactggaaaatttctctttctattcatgggaggagaggaaatctaactggggattgagatgaaaagaagaaaaaaaggattgaatcctcttttaatatctatgrcattattttaaatcacttcagaattccacaagatttatatgtggaaaatgacatctttgctgattgcaatgtggattgcaactgtccatctaaaatatgggatcctgtgtgtggaaacaatggcttgtcrtatctgtcagcttgtcttgctggttgtgagacatccattggaacgggaataaacatggtaagacatcctatttgacagaacttttttgagttgcattggtacttcccaactatgaactgggcctatatttaataaaagtaaaattagtgtttcctcaaaaccatattactttttttgtatgtggaaaaataactctatgatggtcacttgattaccttttatttcccagatcttatgtgaaacctccatagcatctgaccagtgatctgaaatttccaagaagtttatattattactcaaataatttgggttstaaatactctggactaaaaaaattttatcattgaaataaagttggtggttttgatttcaattgtccagctaattgctttgctatatatatatacatatatatatacacacatatatatatttctgtgtatatgtatggatgtgctttctgtgtttttcacattctgacagttctttgagaatttagaattaggaatgttctcttgcctctaagatatcacaatataatataacatcaattgtaatattaatataacgttggttggtgatcaaagtaaactataaattttgattcttattaagacctggaaacatgtaacaattcaaaaaaggttgacaattctttttttgaaagaaactatttcttttcttttcttttttttgagayggagtctcactctgtcgcctaagctggagtgcagtggcatgatctcggctcactgcaacctccacctcccaggtataaacgattctcctgcctcagcctcctgagtagctaggatgacaggcacatgccaccatgcccgggtaatttttgtatttttagtagagacgggatttcaccatgttggtcaggctggtctcgaactcctgaccttgtgatccgcctgccttggccccccaaagtgctgggattacaggcgtaagccactgcgccctgctgaaataaactattcctttgaagcaaagctttatttgtaagcatctaaatatttcagttgagcactctgaaacagattttgtttgtccaatgtagtgttgtatcaaaacactgttttaaaaagtgtattagctgggcgcggtgtctcacacctaggaatcccagcactttggaaggcagagaccggtggatcatctgaggtcaggagttcgagaccagttggccaacatggtgaaatccatctctgctaaaaatacaaaatgtagctgggaatggtggcaggcgcctgtagtcccagctaccccagaggctagggcaggagaatcacttgaacctgggaggcagaggttgtagtgagccgagatcgcaccactgcactccagcctgggcgacagggtgagtctctgtttcaaaaaaataaataaataaataaaataataaaaaagtgtgtctttagggtaacttattagttattacaaatttactattcatatttagaaaaatataccgtttttctgaaatcacccttccagttttgttatatggtgtaatcttgagagacatcataatggagayggagtaaagggaacaagcagtctccatcttgatccaactggctgtgtagaaaatgtttaaaatttgtgttcaagatttttacttcttagtataatatgttattttttggcaggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtacaaaattattttctttatttatatttttttggggtcatttattaaggtagcttgttctaagaaagtcactcaggactcagtatctaagaactcagtgctctaaygtaccatttattaagggttttgtattaagcattgttkgatttcacaaaattttaaagttagcaatgcacatgttcatctgctggcatttcactcctattcctcgctayttttcttccttatttcttagagttaaatgagtggacctctcattttgtgacaaaagagacacatttatatcttagggtaggccgtataaaatggccattttgataggtaaagagtgggtgcctagcagccatttcctagggttcaacctataggacagcagtgcaaagctgtcagaagcccccatctcgctaaggtcacttgatctttctgagctccatttttctttaataataatgggcataataataaatacttggctctcttacaaggctactgtgagacatcaatgctgaaagactttctaaaactaggaaattgcagagccagttttcaaatttaggtatattaaataaatcttctttcaactacaccagtctttgtgcctagtaaacaatcctgaasataatttgcattttttctctctttttcttcttcttttggagctckaaagtagagttcagttaatcacaatgctcaagtcataacacattatcatcataggccagtgcaaggattctctcttattttacttcatttatttatttatttctattcaattccctacttccagtcaccatagctgctcacttaagtatgacagatagatgtcttaaatatgtatttcctttgtaaaatattagaattttttgtgtgcatctgtttttatattcacaacaatggtggtgtggtgttaagtcttgttccgattcataaggtagatgcatagataaattcaccagtcctatttagagtaatttttatatcatcactgcatgagagttagaattatctaactttgtgatgttgactaatccaatgggtgtaaaatactaatgatagctcattgatgtgtcaatatgtgatgtcctgatacactgagcttaagcatctcttcaaataactttgtagctaaaagttattcatgatgcttattcaatttattttacccactttactcattatatttcctgcatcctatgtttttcttgatgaatttgatgattactatgtaaattacagatattaatgtaatactgtttatatgatacaattatcttcacttagtctgtcttctttcttttaacttttacagtgccatttatgaaatgaaatcctaaattttgttgtactaaaatctaacaagtttcttaccttagtgtttgtgtatttggaagagaagtcacatttttaaaattgcttccacatttctaacttataaaaatattcccttaaattttattcccccctggctttcccgctttaccttttgcatagttttttaagccatctcaaatctatttttatatgtggtttaagggacatagatatccagtgttatttttctccgaataataaagttgttttccaaaatcatagtgtatataatacgtcctttttcctttgatttgtggtgccaccatctcaagtttttataattagtgagtctatttttcatccttattctgctccacagatttatttgcctgttcccataccagcgtcaccttgatttaattactttggccttgcaaatgttaatatctcatatggtaactttkcctcacccacctgccatcttcacttttcctttattctttcwttctcaaacttattttgctgtctgtggatctttatatcttcataagaattttgactgagtttgtgtagattccatagattacttggagaaaatctgacatcaaatatttttgaacatgtaatatcctgtcatttgcttaaatattcctttgtatccttaaagttcttaaaaatttttcataaaggtgatgtgccattagattgcttcttaagtactatatataaatatataaattatatatgcacatatatacatatayatgtctctatatgcacacacacatatgtacatacagccacacagatacatacacacacgcatacatacacacacacacactgagaaaaacaaacggtttctctattcaaacagaacacttctgatagccagatgtgtgtattattttcctacactgttcaattctgcaacaccaactgggtgttctactgttccatgcaattctagtgctatctgcatagactttgcatcagatggcaaaagttaaacggttcagtcctacaagactgcccccactttagatgtcaatcacaaaatcacaagtccagacaccctgggctgcttttttttttttttaccctgggcttctgactgacaaacgatgcattaaggttgatgcctccattttctagaatggttcacagaactcagggaagaaacacttttcttacatttactggtttattatgaaggttattataaaagacacaaatggaaaccagggtggagttggggtgtgccactctcctggcatgtggatatgtttaccaactcagaagctcatcaaatctcctagttcaagagcttttagggagcttgatcttcagcacacacatcccactccattctcctggaggtctgagtgtggggctgagaattccaatcttctaataacttggtctttctggtgaccagtcccaacatcagtctgggaggccaccctgtcgtctcattactatagactcaggtgtgatcaaaacaatctccttaagaatgacaaaatacattcctatcactcaggatgttccaagggaattctaagaactccaaggacacgtgtcagaagctagggacaaagaccaaatatatttctagtgatgccatacacacacacacacacacacacacacacacacacacacacagaatggtaccattaccatcacaaatgtacaatatacatatatatccatctacatgtaaatatttgtgattgcaaatatatagagatatgaatatgtatatgattttaaactgatttatatttgtattgattttaaatatatttaaatttatatttgtattgcttgtaaataattgtgattatcaatgtgattgtacatggtattttgtatgtatatgtatatatgtgtatcatttccccatatacaaatataaattttatatctagattataattacatagcatataattaaaattatacataaaataaatcagaagtaaaaattagatttaaaaaattaatcatatataaatatagtttttttaattttaaatttttatgggtatatagtaggtgtatatatttatgggttatgtgagatattctgatacaggcatgcagtgtgtaataaccatattagggtagatggggtatccattccctcaagcatttatcctttgtgttacaagcaattcatttatactcttttagttattttaaartgtacgagtaaattattttccactatagtcactctaatacactatcaaatagtaggtttaattcattctttccattttttcgtacctattaactatctctacttccccaccacacccaggctaccctttccagcctctggtaacaacccttctgctctctatctccatgagttcaattgctttcattttttcttttttttctcagatggagtctcattctgttgtccaggctggagtgcagtggcacaatcttggctcactgcaacctccgcctccctggctcaagcgatcctcctgcttcagcctcctgagtagcggggactacaggcatgcaccaccacacccactaatttttgtatttttagtagaaacagtgttttattatgttggcccggctggtcttgaagtcctgatctcagatgatccatctgctttggcctcccaaagtgctgggattacaggcatgagctatcgtgcccagcctgttctcatttttagctcccacaagtaagtgaggacatgcaaagtttgtcttttggtgcctgccctactttacttaacgttatgacctccagttccattcatgttgttgcaaatgaaagggtctcattctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttgaacatttgggttggttccaagtctttgctattgtgaatagagccgcaataaacatacgtgtgcatgtgtctttatagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcaatttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaagtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccgtgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcaaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcatctgcaaacagggacaatttgacttcctcttttcctaattgaataccttttatttccttctcctgcctgattgccctggccagaacttccgacactatattgaataggagtggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaaggattggtgcattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaactattgattattgccacaatttcagctcctgttattggtctattcagagattcaacttcttccttgtttagtcttgggagagtgtatgtgtcaaggaatgtatccatttcttctagattttctagttttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagttcttttaattgtgatgttagggtgtcaattttggatctttcctgctttctcttgtggrcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattmttaatcctgagttctagtttgattgcactgtggtctgagagatagtttgttataatttctgttcttttacatttgctgaggagagttttacttcccagtatgtggtcaattttggaataggtgtggtgtggtgctgaaaaaaatgtatattctgttgatttggggtggagrrttctgtagatgtctattaggttcgcttggtgcagagctgagttcaattcctgggtatccttgttaactttctgtctcattgatctgtctaatgttgacagtggggtgttaaagtctcccatcagtattggcctgcgcccactgtctggcactccctagtgagataaacccggtacctcagatggaaatgcagaaatcacccgtcttctgcatcgctcacrctgggagctgtrgaccggagctgttcctatttggccatcttggctcctccccctcattcttttttttatggctgaatattactccatcctgtatatgtaccacattttctttatccattcatctattgctggacacttaggttgcttccaaatcttgactattgtgaatagtgctgcaataaacatgggagtgcagatatctcttcgatacactgacttcctttcttttgggtatatattaatacctagaagtgggattgctggatcatatggtagctctattttgagttttttgaggaacctccaaactgttctgcatagtagttgtacttatttacattcccaccaacagtgtaggagggttccctttactctacatactcaccagtatttgttattgcctgtttttgtataaaagtcattttagctggggtgagatgatatctcattgcagttttgatttgcattcctctcttgatcattgatgctgagcaccttttcataaaattgccatttgtatttattcttctgagaaatgtctcaaattttgctcatttgttaattggattattagattttttttctatagagttgtttgagctccttacatattctggttattaatcccttgtcagatgggtagcttgcaaataatttctctcattctgtgagttgtctcttcatcttgttgtttcctttgctgtgcagaagcttcttaacttgatgtgatcccatttatccatttttttttcattagttatctgtgcctgtggtgtattactcaagaaatctttgttcagtccaatgtcctggagagtttcctgaatgttttcttgcagtagtttgttagttggaggtcttagatttaagtctttcatcgattttgattgatttttgaatatggcaagaaatatgggtctagtttcactcttctgcttatggaaattccattttccctgcaccrtttattgaagagactgtcttttccccaatgtacattcttggcatctttgtcaaaaatgagttcaccatagatgaatggattttttttcagagttctctattctgctccattggtctatgtgtctgtttttatgccagtaccatgctgttttggttactataggtctgtgatataaattgaagtcaagtaatgtgattcctccagttttgttctttttgctttggataactttggctatcctggatcttttgtggttccatattaggattaccttttctatttctgtggggaatgtcattggtttattgatagaaatagcatcaaatctgtagattgcagattcctttgtttggttttagcaatattgtttctttcaatttatgagcatataatatattttcatttatttgtatcctcttcaatttcttgcaccaatgttttacagtttttattgtagagatctttcacttctttagggtaattcttagtgattttattgcatttgtagctattgtaaatagaattacttttttttagactgtttgctgttggcatatacaaacactactgattttttatgttgattttgtatcctgcaactttactgaatttgtttatcattttgaatggctttttggtggagtctttaggcttttcaaaatagaagatcatatcatctatgaacaatgataatttgacttcttaatttcaagtttggatgctctttgtttatatttcttgtctgattgctctagctcagacttctagcagtatcttgaataacaatggtgaaagtgggcatccttgttatgtcccagattacagaataagggctttcagtttttccccactcagtatgatacttactataggtctctcatatatggcctttattatgttgagccatgttccttttatacccagttttttgagagtttttttttttaccataaagcgatgctgaatcttatcaaatgttttttccacattaattgaaatgatcatatggttttattcgtttgttcttttggtatgatgtatcatatagattgatttgcatatgttgaactattcttgcatctctgggataaatcccrtttggtcatgatgaatgatcttcttaatgtgttgttgaatttggtttratagtattttgttgaggatttttgcatcagtattcatcagtgatattagcctttagttttccttttttttttttttcttatgtgtctttttctggttttggtatcaggataatactggcctcatagaatgagtttggaaggcttctctcctcttctgtttttcagaatagtttgagtatattgatattatttcctttttaaatgtttggtagaattaggcagtgaagccattgggtcatttctttgctggagactttattacagcttcaatctcattactttttattgatctgttcaggttttggatttcttcatagtttaatcttgatgggttgtatgtgtctaggatttcatccatttcttctaggttttccaagttattggcatatagttgttcataatagccttgagtttaacatagtttaacaataatgtcttaaaatcctttggatgtctgtggtatcagttgtaatgttttctttttcatatatgattttatttatttgagtcttctctcttttttcctagttattttggctaaagggtcatcagttttgtttttcttttcaaataactatttcttttgttttgttgatcttttgtattgttttcttcatttcaatttcatttatttctactccgatctttattatttcttttcttctactaattttgtgtttggtttgctcttgcttttctaattctttaatatgcattattggttttttttcttttcttttttttttgagacggagtctcactctgtcgctcaagttagagtgcagtggcgcgatcttggctcactgcaacctctgcctcctggktttaagcaattcttctgcctcagcctcctgagaagttgggactacagtctcacaccaccacacccagctaatttttgtatttttagtagagacgggatttcaccatgttggccaagatggtcttgatctcctgaccttgtgatccacccacctcagcctcccaaagtgctgggattacaggtgtgagccaccacgcctggcccattgggttgtttatttgaagtttttcttcttttttgatgtaggcatttatagttataaacttccttcttagtactgctttcactgtatcccatgagttttggtatgttgtgtttctgttattatttgttttaagaaatttttaaattttcttcttaattttctcattgacccactggtcattcaggagcatattgctcaatttccacgtgtttgtatagttttcaaatttcctcttgttattgatttgtagttttatttccttatggtcagagaagatacttgatattatttcaattttttttggatgttttaagacttggtttgtgagctaacatatggtctatccttgagaatgatccatgtgctggattcatatttgtattctgtagccattggataaaatgttctgtaagtatttattaggttcatttggtttataatttggatgaaatccaatgtttctttgttkatttwtttwtttttttttttggtctggaagatctgtccaatgctgaaagtgaggtgtgaattcttcagctattattgtattaggctctatctctctctttagctataataatatttgctttatatatctgggtgcttcaatgttgggtgaatacatatttataacttttatgtcctcttgcttaattaatccttttatccttatataatgatcttcttcgtctcttcttacagtttttttcttaaaatctattttgtctgatataagtaatgctactcctgctcttttttggtttctattggcatggaatatctttttcatccctttattttctgtgtctgtctttatgagtgacatatgtttctagtagacaacagattattgggtatttttttaaatccattcagctactttatgtcattgtattggagagcttagtctatttacattaaataatcttattcgtaagaaaggtcttactgctgccattttgttatttgttttctggttttctcttcctttttttcttcctttcagtgaaggtgattatctctagtggtatgctttaatttcttgcttttttattttttgtgtatccattgtatgttttttgatttgaggttaccatgaggcttgcaaatgctatcttatagcccatttttttaggtgataatatgttaaaattgcttgcataaagaaactaataagcaaaaagaaaactaaaaaaaaaactctacattttaactttgtcctcctaatttttaacattttgttatttctatttccattttattttactgtctgtgtcttgaaaagttgttaatatttttgattggttcatcttttagtcttcctagttaagagtagtttatacatcacagttacagtgttataatattctgcatttttttgcttacttactatttccagtgatctttgtaccttcagatgaattctcattgctcatcaacatcctttcctttctgattgaagtactccctttagcatttcttatagcatgggctggtattgatgaaatccctcagtgtttgcttgtctgggaaaatctttatttcttctttatgtttggaggatattttcaccagatataaaggtaaaagtttttttccttcagcactttaartatgtcatgccactctctcttggcctgtaaggtttccaccgaaaagtctgctgccagttgtattggcgctccattgtatgttagtcacttcgtttctcttgctgcttttagaattgtttatttatacatgaccttgcggggtttattgaattccttgaggtaatctttgggttaaatctgcttggtattctataaccttcttgcacttggaatcaatacctttctctaggtttgggaagttctctgctattatccctttgaataatctttctactcttatctctttctctaccttttctttaaggcaaatagctcttagatttgccctttagagactattttgtagatcgtgtaggtgcacttcacttttttttattctttttttcttttgtatcccttactgtgtattttcaaacagcctatcttcaagctcactaaatctctcttctgcttgataaattctgctattaagagattctgaggcattctttagtwtgtcattgcatttttttaactgtagaatttctgcttgattctttttatttatgtcaacctctttgtaaaattcatctaatagtgttctgcattttttctctgtattatcttgaatttctttgagtttcctcaaaatagccattttgaattctccatctgaaaagtcacatatctctctttctccaggattggtccctgctgccttgtttagttcctttggtgaggtcatgttttcctgtatgttctttatgcttgtcaatgtttgttgatgtctgggcattgaagagttaggcatttattgtagtcttcacagtctgggtttgtttgtgccatccttcttgagcaggctttccaggtattcaaaaggacttgggcccgcaagcccaataatgctgtggttcatgtagactcacagagttaccactttggaggtcttggataagatccaaaagaattctctggattaccaggcagagattcttgttcttttgccttaatttcttccaaacaagtggagtctctctgtgctaagttgcccagaagtgggggtagggtgatgcacccctgtggccaccaccactgggactgtgctgggttagattggaatccagcacagcactagtctcacccaaggcccactgttacctctacctggctgccacctatgtttgttcaagacccaactctacaatcatccagtggtaatccagccatgtttttgtctttcccttcagagctgtgagttttcccagtccccaggaaggtccagagatgccatccaggagcctgggatgggtaaaaaatcatacaaatctaccttatgctctatgctagtgtggctgaggtggcactcagactatgagaaacacctttttactcttctctcccctttccaaagtcagaggagccccaccccatggccaccaccaccaccacaggcccacagggaatactgccaggccaccactgacgtttacttaaggcacaagagttctttagccagcctgtgtgaatgctgctaggccaggactcacccttcagggcagttagctctcctctggcccaggagggcaggttcagaaatgccatccaagacccaaggcccagaatctggaactgcaaaaacatgcttggtgctctacccctggggtccctacccacactgggccacagaatattaccagaccctggcctggtaggaatctggcctcacagcaggagggagcagcgagcattaccccctgagttctgcctcctgtcagatcagctgtagcattagattctcataggagcgtgaaccctattgtgaactgcacatgtgagggatctaggctgctcactccttatgggaatctaactaatgcctgatgatctgaggtggaatattttcatccaaaatcatccccaactcctgcctggtcagtggaaaaattgtgttccatgaaaccagtccctggtgcaaaatgtttgggaaccgctgctctaccccattgtggctgagctgttacctaagatgcaagacagaattccctttgcttcctgtgcctgtgcttttctcaaacagagagtctctcaccacagctgccacagctctgaatgtgctgagtctcatctcaatacagcacacctgagtctcacctggggcccataacatactacctgcgtatagctgttggttattcaggccccaagggctctttagccagcatgtgatgtatcctgccagtactgagtccttctcttcaagacagcaggttcccttctgatccagggtatgtctagaaatgccagccaggagctagggcctggaatgggcacctcatgacccttaccagtgccctatcctactgtggctgagctggtatcacagatgcaagacaaagtcctctttactcatttctcccctctcctcaagtagaaggaaggaatctcttttggagccacaagctgtgctgcctgggcttgggtgaagggtggcacaagcacttccttagcttccctggctggtgtctcagtagggaagtgactcccaagtccattggctctgagcscagctcagcactagaacttgcctaggagttgtagtccttgcaacctagactgcctttcaagtttatttagggaragcacgtttgcccatggtggcgaggcttgctggaactcaagttctaactgtggggctgggtgattactttctggtgatagctagtctaaatgctccctccatgggtaagaatcagctgagtttagcttggttttgctttccactgtgacagggcagcacaggatttaataaagtctcagaatcactgcattctccctctcccaagtgctcagattccttctccatgccatgtggccactgctgggggatgggagggctggtgttggcaattcaagaccatttttcctgctctcttcagtgcctctttctgtgatatgaagttaaaaccaggtattgtgagtgctcacctgatttttcattcttacaaaggttttttttkktttttttttgtatgtagatagttgttaaatttggtgttccttcaggagggatgattggtggagacttctatttagctccttgctctacccctcccttataaattattgcactattttggacagataggtctgtstgtgtgtgtgtgtgtgtgtgtgtgtgtgtgtgtccatatttatctctatcatctctacgcataagtagagataggtatatatgtatatgtgtggtactgttctcttatattttctagttggttattgctggtttagaggaatgctgctgtttttaaaaatttactttttatacagcatcctttcttatttgttctcataatttgttgattttgttaggttttctatgtaggtttttcaatgtgcaaatatgacaagttttgtcttttcacttccaaaccttacacmtctgagacttctaaaattctcttatagcataaattaaaacctccaagatttatttaactgtagttgtgatagtgagtattcttgttcttttctaatcttagtaagaactatataaaatttatttattgttattcttactgcagatttttagtgtatctagtttctgtgttattaaaaacaattttttttttttgagatggagtgtagctctatcacccaggctggagtgcagtggcgcartttcagctcattgcaacctctgcctcccaggttcaagtgattctcctgcctcagcctcccaggtagctgggattacaggcacccaccaccacacccagctaattttttgtatttttagtagagacagggtttcaccatgttgaccaggctggtctcgagctcctgacctcaggtgatccgtctgccttggcctcccagtgtgctgggattacaggrgtgagccactgcgcctgaccaataaaataggtattaataagaaaaagtgatgagtaaagtgccagtgaccagaaatgggctcctgtgtaggctgccagctggataataaagccctgaataaccaataagtgagcatgaaagtaaaattttgaatgttcattatgtgtgactagcttacaactggccttttcaagacaatatgatagttttaaatctttatttttcttttatttacaaacttrtttacttttcaggtgtatgaaatctgaagagaagtcccttggtgtgggattacatacattttgyacaagagtatttggtaaaaatagttattttttcccacatcctatcagaacaatattattmktattattttttattacactttaagttttagggtacatgtgcacaacgtgcaggtttgttacatatgtatacatgtgycatgttggtgtgctgcacccattaactcatcatttaacattaggtgaatctcctaatgctatccctccccccttcccccaccccacaacrggccgtggtgtgtgatgttccccttcctgtgtccatgtgcagaacaatattaaatactagataaacaaggtaatattatttcagaaaagcagtctagcaaatgtcccttctgtatgtaaaaagcacrttataaatatgagaatgcagcacacaaagagatagagaatctcttttacttgaaaaggccctgtctgaccttaattacactattctttgtttgaagatttgaaaataaaatgaaagaaaatgctctgcccaaataaaatgtacatataactggcccaaaacatttaagaaaatatataaagttcagaatctttaattcaatgttttactctactaataattatgttgcatttgaccataagattacttatcttttaataatttagaaactttacagtaaaagtaactcatcatttctaaaaataaaatttagaccattagatttatgttttgataaactttgcmgtacaaataaagaaaattgaartatttccaaataaatcaagtatcttaattcttgttgatagatttttctttccctgtcaattgtagctggcattcctgcacctatatattttggcgctttaatggattccacatgtttacactggggaactttgaaatgtggtgagtcaggggcatgcaggatatatgattccaccaccttcaggtaaagataataatttgtttaaaattgttttataagcatagactgtgcataacgcagcaccattcacacgtaactttttctttgtcaagtgaaaagaatacttttgtggttatttccagcagagatactgatgttatatctccattccttatttgcatactagaattgtattttcccattatttctcaagtgcttggtaaatataagcatacatggcttccctaaccttggctttcaaagtgttgttcgttaaattcttagcagtcaacacaatattgaaggtaatggttgtacactgatacctatccaatttatattgctctctaaaggctctcattttatcctgcatgatttcatcatctcacgagtctgaagcctcacttcctctcaccaccagtctctggtctccaaaatcatatattttctccctctttacattttgctgaaacaatcttcttcatgtctcctaatgccttctctttggtaaatacaaatctaattttgaataaaactctttgttatttctattttcatgttctttttcattcggaaatttgagttttgtttaaatttgaattaacttctcttgatggggcaataataaagctacttcattcaatataaaacaatttaccattgtttaaagcattctaagatattggtcttgatcagcaaaaggacacatatcaagaagtatggggagagcagacgcaggagattcatctctgcatctattcccctttcccccagagctccccaggagtgatgctgagggaagctcagctacatgctatgtatgcggtggatttctaccacagttgaggaaccccaagggtcactattgagggttggcctcatcctgctacttggattcttgttgatagtctcctgaattaaatggtgcttaagacacattaaacggacttggctccattctctgttagtcagaccaattagactggtcaatgaaatggtgtatccatgagaaaaatctaccagaagccaagatattctagaaataagggtaaatattgttggtagacaattctccatggatccctacatttctgcttttcttgttagcagggacactgagagcattttttctggactatattttcaaggatgttggaacagtaaatgaccttggaagatataaatagtgtctctctcaaggacagagggcaggtagcttgttgtccatgatgataagaaaatgtctccctttggggcaaagtttgggcagatttttttgaagcccatttaaaagaaagattgggatttcctaaactcaggactttctaactgcagcccaaattcactgtgtgtacaatgtttacctgggttctccctctgtctcaccactttgggacttggagggtaaggaaaatcaacttgaacatgaagcttgtgctgactgctgtgttgtgagtaaaaaaagtcctttgtccctgacctatgagtcttgtatcttctgttagcatccttgaaactgtggcaggctagcctgttagcttacaaatgaagtaaaatcttagactcttttacagttcttgagaacaaacttctgattacctttacattttcctaaaaatgtgaaaatgattaattagatttattccaaccaatagaaggggagaaaatgcagtagtggtaattcataagaaaaaaccccacacaaataagttaaaaaataagcctaagtggttttgcaaattggttaaacttgctggttaaaagatagtaatttttatattggacttttcaaaatttgaactaaatgttgtttgtaagagatagatagatcaaaaatataaaatgattgaagataaggttttgaaaagatctaccagacacatactaaatcaacttctgtagttatattaatgatttcaacaaaatataagtaagttaaagggaaaaaattaatagggttaaccagagatattacttaataataaaaggaaaacactataaaaatatagaaaaattatgaasctatgtaaatctatcaacataacctcaaatatacaaaacaaaaatttataaaattataagaataaatctacagaatggaaaatttcaatatacttgtcccacaaatgaatattaaatacagacaaaaatgagtgataatatagaatatttcaacttcaaattgtacaagagtaattgaatatacagataaatgtatattctgtataaacatatataatctgtatgaatctataatacatctatatctatttctacatgaatacatggataattgttaaccaaaatacgagcacctatgccactaaaaagttaaaaaaaagtattgataccacataaatcctgttttctgttcacaatgcaatggagatgaaagtctataataaaaaattcccaaaccccaaatgtttgaaaagtggaaaagaatgcagtcttaaattactcatggttaaaagaataaattatagtaaacataaataattagaactgtatgtcaatgaaagcactgaataagaaaacttgtgggatgaagctaagccaaccagtaatcaaagggatttttagagctttaaatgtataaatatatatacacatatgtatatatttgcatatgtacaaatatatgtatataaatatgtatataatatatacatataagtacatatatacatatttatttacatatgtatataaatgtatatttacatatgtatagctatattacatatgtaaatatacatatgcaayatatattcacatgtatatacacataggtatatatgtttatatacacataggtatatatgtttatatacacatatgtatataaagatgtatatatttatacatttaaaacataatatgtataaaaatatatacatatatacatttacacataaaaggctgaaaattaatgaactcagaatttagaaaaagaacaatgaaatatgtacaaatgacatagaacgacctgataaatgactcaaaaatttacatattgatatatttcctatctcaaataagaataattgaaacaatatatttttaaaattcaaaagggacttttcttgattaaaagacaatataaatatcatcctaaacatctggtttttcagaaattaaacagaaacataaaggagtaaacaaagctgaattcacaggctctatgtctcaaaatgagcagtggtttctgatatcagcttccaaggaagaataaggtacttctaagtcaagcgactaaattcagattcaatgctttaatccaattaatraggtaaaacaccttttacaggatttagtgttcctcaaaatgtgatattcactcagaacttcacaatgtgaccttatttgcaaatagagcatttacaagtagagtagttaagttaaatgtggttatactggattrccataggcttaaatccaatcactggtgtccatttttttctgaatcctagtamtgtttcataataaaagaaaattttagaagtagaaagataaaaatagatgaagaaattaataaatagactatataccatagagggaataagaaagtaaagagctatgtttttgtaaaggtgcaaagatattactaataacaatactgtggaaaggcaaataaagagaggaggcacaaataaaacatcattaaggatgaaaaagctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtaccaagttcagatatttttcaggaaagtctgaaaaaacctacaatgaaccaatgattcatttgtaaattatgcaagttattctcagaaacagaaaaagggaaaattttgtaattcatttcacaaagctagtactatcttaataatcacactggacaagttcagtacaagaaaaaaatttgtaggctaatcttatacatgcaaaaattctacataaaaattgataaattgaatctagtaatgtataaaaattacagtttattttaagcatgcaaggataggtcaatatcagaaaatctattggtgtaatagatgctattaacacaataaaggtagaaaactttgcatattcttccgactacaagcagaaaagttatttggttatattatgcacattcatgattaaaactttgagcaagctcacaatagaaaataacttccttaatctgatcaaggtcatctaaagaaactctcacaagagtatatattataattcatgatgattctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaattaataagagagtttagcaaagttgcttatataagatcagcatgcaaaaccatcagctgctgtttttatcagaataaaatacaaagatatacaaatttagtttgcactaaccacactatgtaatatttaatatgttttaacttttaaaaaaatagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaatyktcctattatattacttttttcagaattagagaacatgctgtacaacttaattgttttaaaaatcagtagagatataatagataactttttcttgtctttaagaacctaaaaaamctcttaactcaaaataataaaatgttcactaatgatatttctaaggtatcagtgacacttgagttttcctaggagggacatcaataacagccccctaaagaagattcttagmgccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggrgcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggatagacatggagaagagaaacaagagaacaggtagtgagaagtcgagagtcagtaattttcttacttaatattgtggggatcttacttaatacataaagttaatgaaactagaaatagtggtttaatatattacttataattcaaaaattaacctatatttacagatgcttacacagtttctttgtgaatccacctatggttttattttaattaattttttattgcaaagcaatgaaatgttgctttgtggagccagatagcattacagcaggtaaatgggtttctgctagatctccacattattggggagatgctcgaagacctcagaatatacacacccttaaggttcaagggctggggttgagctctccataaggaacttttcctcctcccagaagggcgatcattgtgtatatagacatggagacagaaccagaatgacttctgtgggtggaaatagtgccatcagaatcatttattattatgaaataaatattatttatctacattgaaaaaatactactcctcctaaaatcattaacttttcctcagatgattttaagaaatttgagtaatagcacacgaagtggtaaagacccttagtctttctggtatattagaaaagccttttaatcagtctctggaaggacactagggattgcagctgaataaatatattaagaataacaaatcagttcaacaaggagtagagtctgaagtgggattttccgtggaaattctcttatgtctgtactaacaataagaaagacaagacaaagactaagtaattaaagaaaagctcgaaatgttttgtaaccaaaagcttgaaatgttatgtaaccagaatgttatgtaaccagagctgttagatcagatactggctgattcataggtgaacgtcctctttgtgggtcctctcatgcatccccattttcagaatgtaaataatttggctttgtagcccttccaaaaagggtactatcccacttctcctggcataaatcatacattgactgaacgttcaccatctaaaaatcactcatgctccttgaaccaaggtgattatcagagacagctcctggtagaagaggttgtagatgttaaaagagtatgatttctatataagaaaatatagaaattgacagaatggttcttatttactgggcctggagaattcctgttctggcattcttagatccctcaaatttattaccaaggggaaaaggaaaaagaggcaagtaggcagtagggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttatggaaaaacacatgaattcattaggaaataaggtgacagatccccagctgctgaagaactagaatgtctattacactcatacaattgatgttttattttaatacaccagagctaccacacaaaacttccttccatgtgaaaggctccagataaaattctgccatccctcctctcctcatgtcctcctgctcagacccaccttcatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgtttacattggcttaatcatatcttctctcttccatgtcccttcctttctcctcttccctagaggtcacaaaaatatactccactttcagttatctaagttgtctcccctccttcaaaggggagaaaggctggagagaacatgggaaacatgaatccagtgataataacctcagtcagcaattaatctcatcatccagtttcttccaatgcaagggttaacaggaaaatggtcaaaggttgacaagaagaaagaattggaggaattaaatggttaattcaccaaatgtaaaatgcccccaaactggaaaagcactaaattagttttgaaggaagaacagaagggaggagtgagagaatataggaagaaagaaaggagaggagaaaataaaataagatataaactactttgaagattataaaaatgcaaggttttgtttctcttttttattgtaactcagatgaagcttccaaaaacaattatctatgtaaaaataatttgtcctagaggattctgggaggatagcagagtagggagcaccagaaatctgtcttcctacttagacaacaaattcattggcagattatgtcttatgtaactattttgaaactctggagcctactgaaggcttacaacttccaagggaaggcttagacataaattgaggttaattttggtcaatttcagccattagtagagtagcaactacccatcccccactgtcagttccatggcaggcagctgagcacttgttccaggagcagcttgcatgcagtgtgtgggggccagggtgggcaaaatcatcctgttcttcaaatttcaggtagctgttctcagaatgctggttgctgcttctaaccacaaagatgcaaacacataaatgggcagccattgtttttgcacctcccctcgttgttgcaatcccctccctcatcaattgaagtgatttccagaggatttaaagagccagcactactgttcccccttccattttttaaatttttctccctttgggagccagacattaaagactaagatatttaatagcaactctatatatagggaaaattagaaaggtactgcacatggccaggaaaagacacaagctcagaaaagaccagagatatcaagtttacactttatgctgatccctggcacagaggcagcatgtaagtattaaaaacaacaacagcaaaccctatggaaggggaaataactgatttatagttacaatatttttagattcaaatgtccagcttccaacaaaaagtcacaaggcatataaagaaacagaaaagcatggcctattcaaaggaagaaaataaatcaacaggagttgttcctagaaaagacctgatggtagatctactagacaaagactttaaaacaactctcttaaatatgctaaggaaagatgtggaggaagtcaaaaaaatcatgtgcaaacaaaatggaaatatcaacaaagaaatagaacacttgaaaagaaacatttctgaagctgaaaatacaacatctggaatgaaaaatatactagagggattcaaaggcaggttcaagtaggtagaagaatcagtacacttaaagacaggacaatggaaattattgagtctgaggaacagaagagtagaagattgagaaaaagtagagagatcctaatggacttgtgggacaccattcatcagaccaacatgcacattgtggaagtccaagaagga

SEQ ID NO: 17711 - DNA, 31364 bp, Homo sapiens
cacatatcggtgttagcagtgttccgcgagtggtgcctgagagcagaggagaaacaatacccttgccttcatccaaaatatgtatggaaattactggtcaagtacttcattgatggttccatctaataatgatatggttccgtaaacatttagaaggtttttagatatctagaataggcaaatagacagaaaggagatcactggttgcctggagtcaggggcaaggagaacaggcagtggctgctaatgagtgcagggtttcctctcaggtgatgaaaatattctaaaattgactgtaggaattagctgggcgcagtggctcacgtctgtaatctcagcactttgggaggccaaggcgggcggatcacccgaggccaggagttcaagaccagcctgaccaacatggagaagcctcgtctctactaaaaatacaaaattagccgggtgtggtggcagacgcctgtaatcccagctacttgggaggctgaggcaggagaatcacttgaacccgggaggcagaggttgcagtgagctgagatcacaacattgcactcttgcctgggcaacaagagcgaaactccgtctcaaaaaaaaaaaaaaattgactgtaggaatggttgtacaactctgtgaatatactaatttttaaaaccccattgaattgtacactctacatgggtgaactgaatagtatgccaattatagtgcaataaaactgctaagaagggcatttagaaacaaccgcaacgctagaacaccagaatcccttttttttttgtcagggtctcgctctgtcacccaggctggagtgcagtggcgtgatcacagctctctgcaacctccgtctcctgggctcaagcaattcacctgcttcgatctcctgagtaggggggaccacaggttagccaccacacctcgttaattttttcgtatttgttgttgagatggagtctcgccatgttgcccaggctggtatgaagtcctgggctcaagtgatccacctgcctcagcctcctaaagtgtgggggtaacaggtgtgggccactgcacccggccccctgctaattttgaacaaatttttttgtaggaacaaagtctcactttattgcccaggatggtcttgaactcctggctttaagcgatcctcctgccttggcctcccaaagtgctgagcatataggcgtgagccactgtgccacgcttcttttttttttaaataaattagttgagtttggccctttgtaaatatgtaccaatggaatatatgagctattattaaaaccagatactgttacttctcctttgctatgactaactttttatttctgcagtatatgttgctctttggtttaggggactaacaactttttaaaaaaataaaatgttatctgtgtcttgcagggctgttacagggggttacgagcaaaatggcacctggccgggagggaggtgggggctgaaccagccccaattcaaccaggaaggggcatcttagtgttcacaccaaaaccaccttcaactggttgtgagctaggggtgctgctatggccagtgggggaggcctttaattctaagtcttacgttctgagtgtgcctctttctaattcaaaggtacaatataaatagactgtgtgacctgcatgaaaacattcctgtttgcaatggcacatctcacagaaagttaccatttttcaaaccacctataatgagaatggatgtcaaaatgggattctaacattttgtaagaccctaaatttatcaaataaagagtcaaatatgtgcaatgaactcttcctgagacaggaagaaggggcactttttagaaagatattcaacagaagggttttctagttgactgactatcaaggtagagaaaaccctataactccattcattaaaatatgactattaataccttactaaatatccttctacatccttacccacgtttttatacacatgcttttaacacgtgttttaaataacaaaaatgagattccactaaatcaactattttaacctgtcccactcactcccctctttattatactttttgtgtcaagttgatttatttattgaataaataaaatccagacttttctgtttaagtgcctgaatttgttcttacacaaagcaagtgctctcaagaagctcattcttgaagatggttgagaaatatcaatgaccaatatcaaaagaacattaacccatgaaatgtacatgaatatggccacgcgtggtggctcacgcttgtaatcccagtactttgggaggctgaggtgggtggatcacctgaggtcaggagttcaagaccagcctgaccaacatggtgaaaccccatctctactaaaaatacaaaacttagccaggcatggtggtgtatgcatgtagtcccagctacttgggaggctgaggtaggagaacagcttgaactcagaggcgggggtggaggtcgcagtgatccaagaccgtaccactgcattccagcctgggcgacagagtgagactctgtctcaaacaatgacaagaacaacaaaaatttacatgaatatgcatatcagctgaaggcaagcacattacaaatgtaagtacaatttagtagaaggggtgagggagcctgggtgtcaatggggaagccttggtgagctcctagaagtaggatgaaggctgtgagacagtctcagtcctggtgatacagtcaggatgatgtaacagggttcagtgagggagtgcaaggtgacagaacaatatggagtatcttatactaattcctgcaaacttctcaactatgtacaagaaaacaaatacttacgaaacagaagaaaatggccaggtatagtggctcatacctgtaatcccagcactctgggagaccgaagcagtatcacctgaggtcaggagttcgagaccagcctggccaacatggtgaaaccctatctctactaaaaatacaaaaattagccgggcatggtggtgggcgcctgtaatcccatctactcgggaggctggggcagaagaaccgcttgaacctagggtggggtggaggttgcagtgagctgagatcgagccattgcactccaacctgggcactaagagtgagactccatctcaaatttaaaaaaaagaaaaaaaaagaaatagaacaaaacacagcagtggatacagtgctttttggttcattcaaagcagtcccatcagagtagcatattaaactatacaaacggctccaaatggcaaaatctagacagtagaaaatcccaggtcctaattatgttgtcaaataacttacaaaaaaaaaaaaaagatgaaggaagaagctacagattaaaagagatttaacagatttatcaaacaaataaaaaaggacttttggaacctaattcaaataaagttaaaatacatatgacatttacaagaaaactggaaaatctggacagtagatatttgatatcaagaaattcctaattttttagatgtggtaatagtattgggttatgctttttaaaagtccttatccattagagatgcatatagaattatgggtgaaataatatgatgtacagaatttctttcaaaataacatgggaagggcggccaggtatggtagatcatgactgtaatcccagaactttgggaggctgacatgggaggatcgctggtgtcaaggagttcgagaacagcctgggcaacatagggagactgtctttactttaaaacacacacacacacacacacacacacacacacacacacacacaaacacacacacacatacaataaaaaataataatatgagaaaggagaagtggataacgaaagcacagacaaaagaagactgggcttgagctaaatcactgtggaagctgtgtgatgaggacaaggggtttcaacagattattctgtttttgcatatagttgaaatccttcataataaaagttaaacaaaaaagtgctacaaatcctaacgctgacactaaattctacagcatgaagaatttatggaagagtgagactctgtcaaaaaaaagaaaaggttgtggaaaattacctaatgatacaaaaagtataataaagggggtgagtgggacaggttaaaatagatgatttagtggaatctcatttttgttacttaaaaaaagcatgtatcatgtatataaaagcatgggtaaggatgtagaaagatacttagtaaggtgttaacagtcatcttttaatgaatggagttataggcttttctctaccttctttattacgtttaagaatttaatgataaaaagtcacgcatgttgtttcaccccagcagtgttggctttactaaaaacacatactctaagaatcccatacatgaaaggtggaacttaatcaagaacatgtcagagagaagctgcttgagcaagaaaatatctgaaaagcaagctctcctagaagagaagcaaggcctccttaacagtttataagcacacacctgttaggggcacatactgcctgccagtgcctttcactctaagtctctctgtaagctgtaaaagcaaacagtttaatggcaaatacatactctatccaggttaaggtgccacagatttataaacgtgtaaaaacaccagaccttgttttggggttaaggtgagaaaagggcttgctaaacagtctctttcctagaaggaagttctcttacccactcactccctgggacagaaggtcaaagagcatctctggttggaatcataatgcttcggcctgaagtgaccaggccactcactactttagttgcccaagcagtatcaaaggagctcacctcatagtctttccttggaagaatctcatcctcctcctcctgtgtttctccaaggatggtctagaaaaacagatccgcagagggagccttttttagtggttaggagtggaaggaggcagaagtatttactgaaatcagtggctagcttctaaatcatctggagccattatcaaataggaaccagccctcaaaaaaaacctttcaggggtgagggaccatgtgggtgaggatctacagccatcagctgagctcttcatttccactgatagtctccaaataaccaccctcctcttcaggacacctcaaagatgtccaacgccagctgaaaaggggggtaaaaatgcaggttccatttgacagtgtgacgtatctgaaatcagaaaggacttgtcaactctgggaacacaactcaagttttcccaggatgctttgcagggggaagctggactgtcagtgacccagaaagggtgagggatagagtgagaaaggactggagaagctaaaacagcagcatgataagcacaaagtcctgtgaggaagctcattctgaaaacgcttgtttcattccaaactcttttcagatggaaataaaaggaaacatgggtgggatttactggagctggcctggattctccctcagattccaggaggggttatgagaaaagaccccagacttaggcacgtgaagcagggtagacgcttcgagagccctggctgcggtccccaggccccacccgctgccacctgcgggcccagattggcccggccccacccccggcaacgcctctctcagtcccttagcaaccgccccctccccaggccgactccgccggcttcttaccagctcctcgggggtgcgggtctcacgctcaccgcagcagcagcaccacctgcagcagcagcacagagaccccctgcaccccgccatcttcctcctttactgccactctggacccctctaccaaccccctcccagccaggatctgcgcctcacgtgactggccccgggacggtcacgtggccctctcgagctctgggactgagaccaggagtggctgcagacgggtggggcgaggactcgcgtcacatgacgataaaggcacggcctccaacgagacctgtgggcacggccatgttgggggcggggcttccggtcacccgcgccggtggtttccgccctgtaggcccgcctctccagcaacctgacacctgcgccgcgccccttcactgcgttccccgcccctgcagcggccacagtggtgcggccggcggccgagcgttctgagtcacccgggactggagggtgagtgacggcgaggccggggtcgccgggagggagatcctggagccggcaaacaacctcccgggggcaaggacgtgcttgtgggcggggagcgctggaggccggcctgcctctcttcttggggggggctgccgcctcccttgcgcacccttcgcgggattagtgtaactcccaatggctaccacttccagcgaccgccaaccctcaagcgaagactgactttggctccctgcctggacggaggggcccctgagccaggggtgacgatcccgcccctctgaccggcccaggcccgtgtcctcgcccccatcggtgactcagtgacctggtgactggattctcggccacctgggcgccgagacggcttccggctcctgccttttaaacctgcctccccggcgakcacctggagaagagcgctgggcccggggcactgcggtccctggcgcccactgcgtcccgctgcgcacgggggtccgccgggacctttctgggagtcgtaggcttagtatcccagtgcttggcgcagactagttgttcagtaagtggcagaggcttattttgagagagtggcagcacctggccctttggcgctcagtgaatgttggctatcaccgtgtgccaaactctggggataccccaggcaggacaccggtcctgtctcagggaactggggaaagagaaaggagacaggycttttcacccacagttacaacccagggtgctatgggagtccagctgataacggataaatcgtgggagttggcttacaaatatggcacatgcgtggcatatactaggaatgcaataagtctttgaaaatcagagggtttacaggtggttcagcttcctcctactctaggttctgttccagcaagcaattaacgaggtgcgcccttaaacgctggaggaaagccaactggctgctcttgctgttactcctcccccccgcccccgttcctcactccccacagccatccccactgagaatctggagtttgaggtcagaatgaaagagagcagccctagagggagaaagctttggcccagggttcttagtctggaatcaactccttgtctttggatgtatccccgtgtagtctgtgcacctgtgtgtgtatttcaggggaagggagcagtgcatttaatcagattgtcaaaagagtctaagaccccaaatggttaggtacacagggttagtggtggacagtctgaaagaaatgaacctcacctgggctttcctctgttgtgccatgtcaccacacacccattcactactgtgtgtttgcccattgctgtgcaagtgttttgtttgtttttaagtgtttgtcttattttcttaaccagactgccagatgrccctatgccctctgttggcctgtctgtgccctggtggctctgattacttgtttctgttttttgtttttgttttttttttttgagatggagttttgcttttgtcgcccaggctggagtgctatggcacaatcttggttcactgcaacctctgccttccgggttcaagcgattctcctgcctcagcctccagagtagctgggattacaggygcccgccaccaaacctggctaatttttatatttttagtagagtcgggatttcaccatgttggccaggctggtctcaaactcctggcctcaggtgatccacccacctcggcctcccaaagtgctgggattacaggtgtgttttttgtttttttaagagatggagtctcgctatgttgcccaggctggccttgaactcctgggctcaggcawtccttctgcctcagccttcccagtagctgggtcactgtgatgatttgaattgaattctgtgatgtgtaagaagagcagcctgcaaggcaagcacagatggggcagcttttgttctgagaaattcgtgcccttactgaacttgggtctggctatttttggaacatggccagcatcaagttctaacccacaacackgtctttttggagtagcatgaattcaggagaaatctggctgcatagtcaagccctcaccccttccatcctrtgcacgaactgtttcaagtaacagatgttccaggcagagccagccagagtgagctgttccttctctggagggtgatctggtatccctgaacgcctgttggcctcatctccaccaacccctgcagtctctgcccctgagtccccctccttccatccgcctccccttactagagcctcagccctccctcctcgcctggaagccttgcccccgcccccttgtgctggctggagctcaagcctcttcctttgtcgcagctccgcccagttgaacacacccgctggggaaggtgcctctgttccctccccacgcactctgggcctgagctgacagagatggaccatcgaaaagccagggtcctcccagctgggcactactgcccctcgctaggaatatgggcctcgcaggtcggcagcgtgaggtcctctgtgccaccttccatcaggtagctgtcaccgaggagcatgttgcagtgccgggtgggggctgccttgcatgcaaggagcctggcagcagcggagggcaaggctttgagtgaggcggcccggacagccatagctgaggagcatggagccactgggagggggcagtgtcaccttttttggccttcttcctgtgtggaaatacagygcctccggcttgaacctgccactcaggtgtcttgatgtgtcgggggtgtggctgcctgccccctgatgctccctgccccaccctgtgcagtaggaacccagccatggtgaacgaagccwgaggaaacagcagcctcaacccctgcttggagggcagtgccagcagtggcagtgagagctccaaagatagttcgagatgttccaccccgggcctggacccygagcggcatgagagactccgggagaagatgaggcsgcrattggaatctggtgacaagtggttctccctggaattcttccctcctcraactgctgagggagctgtcaatctcatctcaaggtraactcatgcaaggttaaggtgggaggcgggagtggtggtgcctggggagcaaactgtcagccctgaggctgggctgccctttaacccggcagaaaaaagcagccggagggggcaggaaggagaaggcagagtgggtcatctgatctgcaacttctctgttgcctgtaaaagtccctccacagtgtcaaggtattttagacacactcttcaatgggttaaaaatgttgattctcacactgtattctttgagggaacttgggggctggatcacgagtgcagtttaggaagtcacaaagcagtgagattgttttcagcaagttagaaatttggattatgcttcttgaactctagaaatgccaactgaattacattagcacttcatgaattgcagttttttttttaagtttatgccttttactgtatgcacgtctcacgtgtcactcccaagtttttgaagtttaaatgcacaaggatgtttaaatacaccgttgatagcttgtaacacaagtactcgtgcacatccaggcttttttttgagtctcgtttcggaacttggccttggtctgcataactgtaagctgctgcacagggcttggggggtggcatgaaagaaagtgagtctgctgaccctctttctaactgttcctacagcgaggctgtgcttgccacagttaggattcccctaactctcaatcatgatgtcttaactcacctgagatartaaacaggcaagcgctgtgaaaagtctgaagtgctgctctcacacaaaatgatagcgctgttgttgtgtcttacctctgtaatagtgattataacggcacctcacatatactgagtattcggtttgtacaccaggcactgttctaagttctgtggaaccagctgccgtcatattctcctagtgttatggttttttgttgttgttgttgctttttttttttgagacagagtctcattctgtggcccaggctggagtgcagtggtgtgatcttggctcattgcaacctctgcctcctggctcaagcaattctcctgcctcagcctctcaagtagctgggattacaggtgcccaccaccacacccagctaatttttgtatttttagtagagatgaggtttcactatgttggccaggcggtctggaactcctgacctcaagtgatccactcacttcagcctcctgaagtgctgggattacaggcgtgagccaccacgcccagcatcctagtgttattatgaagtgggtactactatctgccgtgtcttataaataaggaaacagaactcacagagattaagtaatgtacccaagatcacacagctataagtagcaaagccaggatatgaacgctgattggtctgtctccaaccttcattgatgcttctctaactcccgggccccatgggaaggcagtgacggatggtatttctcctggaacctctcttcagaaacaaaccccctacaggtttgaccggatggcagcaggtggccccctctacatagacgtgacctggcacccagcaggtgaccctggctcagacaaggagacctcctccatgatgatcgccagcacmrccgtgaactactgtggcctggagaccatcctgcacatgacctgctgccgtcagcgcctggaggagatcacrggccatctgcacaaagctaagcagctgggcctgaagaacatcatggcgctgcrgggaggtgtggagccagcactcccctacactctgggttctggctttcccggaggccacttggtagcctgaacttggttcctgaaatggtcctttacttcytcctgggccccacgctgaggatccgcaggatcccatccccgccagtagtgtcagtaggcattgtgggtagtgagtcatcctgggcaccacacacaggcagccacctcttccacctcttgacctcgacataggagttccgtcaggaatgcagtcgcggcctgataaccctctgccttgcctacaccactgcatcgattgctggctgcacccagcacttggcccaatcacagagtaacagagtatccaggagtgagaatagccggtcaggcctctggtgcccgctgttgtcaggccacctaagagtgggaagagggagcctgatgggtgggatcctatggcctcgtgctccctaccacaagaccccttcacttgagatgagtagaaaattctcccaggaggcaggagccccaaggccgtgggatgggagagggtggcaggcgtgcccaggtagaagtagggaagggctctccaatcctccaggcacggtgagaagcagcggtggtctcctattctccaccgccagcacagggtcagcatgcagtgaatattgaactggtgggctgcttttttccctcctgctgtcttaccaagtgctagaaagagacgaaccaaacctaaataatatgaagtttctgccttccagggactcgcrgtcctsggtgtcrggrctaggtagagggaacagaaagggtctctggaggttgggtgagacccagtgactatgacctccaccaaccctgcagacccaataggtgaccagtgggaagaggaggagggaggcttcaactacgcagtggacctggtgaagcacatcygaagtgagtttggtgactactttgacatctgtgtggcaggtgagtggctggatcatcctggtggcggggatggagctagggaggctgagatgcccagagagcctgtcggtgttcggttcaggacacagtgatcaggggcactcatgggtccatgctggatgaaggacatgcagaggtgaactgcaccgtgtccttgctccttttgtatcacccactcccctcctgggcctgccaccatcgacccctagctttttgttcctctgcctggctgtgcccttagcctgcttggccttattcttttctttaaaacgaaagaggggtctgggcgcggtggctcacacctgtaaccccaacactttgggaggccgaggcaggcagatcacctgaggtcaggagttcgagacctgcctggccaacatagcgaaaccccgtctctactaaaaatacaaaaattagccaggtgtggtggtgcacggctgtagtcccagctactcaggaggctgagccaggagaatctcttggacccaagaggcggaggttgcagtgagccgagatggtgccgctgcagtccagcctcagtggcagagcaagactccatctcaaaaaaaaaaaaaaaacaacaccccacaaaagagggatatttactaacaggattccagagggcagggaacccaagatcaggagatggcctcagacctcacaaggcactggaagaggtcaaaaagcaaggccctccctcattccctctggggccacagggtcccccatctccgcttcccactgcacatctgtgcttcatctgggagacctgatacccatgcttttccacacacctggcctgctcctgagtgtgcagagtgtcagttccagccagttccccaggctaatggacaggcctccgttccaaattcccaggaaagagaatcaccattggccacagccacaagaccaggttcccccaacagaaatgggtgggttggacttctctcccacccttgaagctgaaggctggcattgagccctcagcgtctcagacagcgctcaggtatggcaagacagtgtgcaccagggacaggaagtcccgggattggcacattttctgggatgacagtttttttgccaatattctgggagaaatcctaccatttttatattaaacatggctatgttatggagtagcatctaaagtgatatgaactaaaaaaaaaaggccaggtgcggtggctgaagcctataatcccagcactttgggaggccaaggcgggtggatcatgagatcaggagtttgagaccatcctgtccaacatagtgaaaccccgtctctactaaaaatacaaaaattagccgggcatggtggcgcgtgcctgtagtcccagctacttggtaggctgaggcaggagaatcgcttgaacccaggaggcggagcttgcagtgagccgagatcgcaccaatgcactgtagcctgggcaacagagccagactccgtctcaaaaaaaacaaaacaaaaaacccaaaaaacaaaccacgtggcttcaagaaaattacatgttgtgagtaactttggccttgtccctaacccccgatggacatgtccattctgtcaacaggggtgtttaggtgctaagtctgggaagcgctgattaggagtcagagaacagacatttccaactgttaaattgtcatcgcttgtatcagccattatatagtcagttactgggggaatatgcacccgtgatgggcgttaggtgataatgattggaaactagtgaagctgtgagctcacagttgctgaatggtttcttactttgcttatcaagtgggtaatgaagatgagtggattagaaaacaccaacctgttgggcatggtagctcatgcctgtaatcccagagctttgggagactgaggcaggagatcaagaccagcctgggcaacacagtgagaccgtgtctctacaaaaaataaaaacattttaaaaaagaaagccctcagctgttcatgatagaaaaatagagtaaatagcaaaatctatacgtaatcaaatgctagatttgttcggtgatatttaggtattgtagctatacttttcagctattaaaaagccttgttgtttctgaaattcctactgggaaaatagctttgttattgcaagtgtgaagccccattgctttatcccccactcccttaccccttgaaacaatagtttttatattcattttttgatgactctgggtttcttaagaacggaactgccttatcagagcaaagcagcttggccttccgcctggctcagagtcctgccctgggcttgggctgatgaaaccagcactccatgtagtttcatgaaggcctatggtcrtcctgcttgcctgaccgagcaaggcggctagtaagtttagtcattgaggaaaggggtcagagagttcacagagccagtaaggagcctatgggacatctgatcccacctcctaagcaattctggaatcttgtcttcagcatccactgcccctgtgttttcagactccaggagctcattgttttgtgagtggcttatagtactctagccagctctctgaaccggatgctggttctgccattrgaaacaacacagaatatgactaataaagaacttcactagggggctgggtacagtggctcatgcctgtaatctcagcactttgggaggccaaggtgggaggattgcttgagcccagaagttccagacaaacctggacaagatagcaagaccccatctctaaaaaataaataattaattaaaaaaaawttttttaattagccagatgtggtggcttgcatctgtagtccaagctactcaggagactgaagtgggagatcacttgtgcccgggagttcaaggctacagtgagccatgattgtaccactgcactctagcctgggtgacagagcgagaccctgtctctgaaacaaaacaaaacaaactcacctatggtggatcctttttccccaggacagacctttggacatttgaaaggagtttctgtattcttttcattcttttttttttttttttttgagacggagtttcactctcgttgcccaggctagagtgcaatggtacgatctcggctcactgcaacctctgtctcgtgggttcaagcaattttcctgactcagcctcctgagtagctattacaggcatacaccaccacacctggctaatttttgtatttttggtagagacggggttttaccatgttggccaggctggtctcgaactcctgacctcaggtcatcctcctgccttggcctcccaaagtgctgggattacagacatgagccaccgcaccctgccatccattattttctttgaagaaaacatcactttcttcagttcttccttgtgtaacttggtttttagcttttcactatcttggacccctgagtaatttcagtgttacattaaaaacaatgtttaatccggtgcctagagaaaagtcaagcttagtaccccagatgctgcccagccagtgctaactgtagcattttctcttttctatggccaccaagtgcaggcctgatttgcttggctgctcaaggcaggacagtgtgggagtttggagcaatccacccccactcttggaactgggctctgagccacctcccctgagagtcatctctggggtcagaagcatatcagtcatgagcccagccactcactgttttagttcaggctgtgctgtgctgttggaaggtgcaagatcagagcccccaaagcagaggactctctctgcccagtccctgtggtctcttcatccctcgccttgaacaggtggaggccagcctctcctgactgtcatccctattggcaggttaccccaaaggccaccccgaagcagggagctttgaggctgacctgaagcacttgaaggagaaggtgtctgcgggagycgatttcatcaycaygcagcttttctttgaggctgacacattyttccgctttgtgaaggcatgcaccgacatgggcatcacttgccccatcgtccccgggatctttcccatccaggtgaggggcccaggagagcccataagctccctccaccccactctcaccgcaccgtcctcgcacaggctgggggctctgggtggagtgctgagttcgctgagttcttcccagatctcctctcaggtccagaacttgcacagcgttgcttggccaccccattttggttacctctaattttccccccaaaacccagcaacagtgtctgttgaggggtttgttgtactttggccaacaagcatcaccaaaagggattctaattctcattacaaatcctgcttaaatcagtgtttcccaaaggtggctgtcatcagaaccacttgataagctttttcaaaaagtggatctccaggtcccacccctggaggttctcactcagtaaatctgagggaggtccttggaatgtgtgttttacttcttgagcttggcaggtgattcggatgatcagtgcagcatgggaacagctgggttagatgacaccatgttaccaacagacacatctagggctaaaaggctggctcaacccaaggctggaatgcttagggcagctgctctactctgtaaaaagtgggaaagctgggcatagtggcacgtgcctgtagtcccggctacttgagaagctgaggcaggaggatggcttgagccctggcgtttgagagcagtgagactcagtctctaaaaacagaaaaaagaggagaaaacggcaggccaagcccaggtgtgctcctagaatatgatcggactttcgtgggtccctctgcctgacactgtggttggcatggatgatggaagggggagaagtatttagggtgggagacrggctggccagcagccgccacagcccctcatgtcttggacagggctaccactcccttcggcagcttgtgaagctgtccaagctggaggtgccacaggagatcaaggacgtgattgagccaatcaaagacaacgatgctgccatccgcaactatggcatcgagctggccgtgagcctgtgccaggagcttctggccagtggcttggtgccaggcctccacttctacacccycarcygcgagatggctaccacagaggtgctgaagcgcctggggatgtggactgaggaccccaggtgagggcagtggcccagagatccccagaggagggtccaagagcagccccggctgcagtgctggctccccacggtggtacagrtggatgtctgtgccatggctagctgggcacatcraaggctccagtctcagagggcatcagatggaagaactcagcctcaggggtgctcccctgcttccggctccctctagccaatcccttgtctcaattctctgtccccatcctcrcccaggcgtcccctaccctgggctctcagygcccaccccaagygcygagaggaagatgtacgtcccatcttctgggcctccagaccaaagagttasatctaccgtacccaggagtgggacgagttccctaacgrccgctggtgagggcctgcagaccttccttgcaaatayatctttgttcttgggagcgggagggcagaagaagtttgcatgcttgtggttgacctgggaggagtcaggggcagaatttacaggaatggcctcctgggcatgtggtggcactgccctctgtcaggagtgtgccctgacctctgggcacccctctgccaggggcaattcctcttcccctgcctttggggagctgaaggactactacctcttctacctgaagagcaagtcccccaaggaggagctgctgaagatgtggggggakgagctgaccagtgaagmaagtgtctttgaagtcttygttctttacctctcgggagaaccaaaccggaatggtcacaaagtgagtgatgctggagtggrgaccctggttcatcccctgcccctggcctgaccccagctgcaggccaggctgcggggctgtgacttccccatcctgtgccctcccctccatgctgtggacatggcaaagggagaagggtaagttgggagacctccacctggaagggcttagggaggcaaagacaggctgggtctttgttgggggccgtgagagggactcagggtgccaaacctgatggtcgccccagccagctcaccgtctctcccaggtgacttgcctgccctggaacgatgagcccctggcggctgagaccagcctgctgaaggaggagctgctgcgggtgaaccgccagggcatcctcaccatcaactcacagcccaacatcaacgggaagccrtcctccgaccccatcgtgggctggggccccagcgggggctatgtcttccagaaggtgtggtagggaggcacggggtgcccccctctcttgaccggcacccgtkggttccccagagcttagggcagagcagcctgcctctcctgggctcttaaattttgaatgagcatggattggagcggatgggagctcatgctttaagtcagatagacctggctgggcacggaacccggccagcactttgggaggccaaggcgggtggatcacttgagcccaggagttcgagaccagcctgggcaacatggtgaaacccattctctacaaaaaatacaaaaatgaccgaggcatggtggtgtacacctgtagtcccaggtacttagggggctggggtgagaggatcgcttgagtccgagaggttgaggctccagtaagccatatttgtgcctctgcactccagcctggcccacaaagtgagaccctgtctcaaaaaaaaaaaaaaaagattggctgggcttggtggctcatgcctgtaatcccagcactttaggaggccaaggtgggcagatcacaaggtcaggagttcgagaccagcctgacaaacatgatgaaaccccatctctactaaaaatacaacaattagccgggtgtggtggcgggcacctgtagttgcagctacttgggaggctgaggcaggagaatcgcttgaacccgggagacggaggttgcagtgagctgagatcatgccactgcactccagcctgggcaacagagcaagactccatctcaaaaaaaaaaaaaaaaaagatagaaatcagacctatggaggcaggtcactcgacctctctgagcctggttttctcgtctgtaaaatgggatgtagcttgtgttctgggcatgaaacctaacaaagcatgtaacgtgcttggcacatggtaagagcaggaagcactccctgaaaggcagctgctgttactatcctgagttgacacctttctcccagggctgctggagttaacattatgttctgatctaaggcccacrggccctggagcagaaagacctgagtttaaggaccagctctactgtttactgtcagagtagccaacgtgctcaacttccctgaacccactttcctcacgtggggctcactgtgcccagcctcccgtattatcagcattctagcaaatgagtttgagtaaacccagcttaatccctgataggcactggttctagaggagatgtcaatgtcattgtcagcttgcactggggaggatggaatgtgtggggcctctctcccatgactcggcctgtcaaaccagttgctgctgttcagaaatggcttcttcgtggagtcttccctgactgattgggagaggggtggctgatagccctcagacctgtccagactgagaaactcacgtccccactcccctcaccctttgcttatggacgtgccaacgccacagttcattattccgcccacatkgctgccartagtcctgataccttaggtgtctgcgaaagggcgtctggcagggctggggttggtgacaggcacctgtctctcccacaggcctacttagagtttttcacttcccgcgagacagcggaagcacttctgcaagtgctgaagaagtacgagctccgggttaattaccaccttgtcaatgtgaaggtaggccaggccccagggttcccacagagtaycargcccttcgttgagcaaacacccagcacctagcctgggctaggcattgtgcaagacagasagatacaggcagaactggggccctgctcttaaggagctcccagcctagagtgagggaggcagatcaatgtgtgaccaccagccagtgtaagtgggaaaatcaagttcaggagaggatgctgtcrggtccaraggagggatatctcacctgggaggccagggaaggcttctcagagggtcatctgtgggaatcactgaggasaaagaggagttggccaacaggagagaagggtattcctgggacagggcagaggacaggcagaggcagtgagctgcaccatctggggaaacsgggaacatgagcaggaggaggcgggagtgttaagcaggggccaggcccgcagagatcatggttgtcctgctggaatttgagttttccctcaatgcaagggaagcctttctccagcagtggggtggcttggttcctgctttattttaggcaaatcacagtggatagtcatacggatgagagagattggggacggctagagccggggaggccagtgaagagacccctggagtgacccaagccaaacacactcctggaggtgggctagacaagagggaatggatcagagagtgagcagggggtgctcaaggaggagaggggaagtggccaggacgcctctaggttcaggcttgtgtggggagagatatcattcacagatgcaggcagaggaggccaggagcggaggcacagggagaggggagtggaggcgcagggagagtggaggccgggagtggaggcgcaggcagagggtattgagcccagacagcctcattgagtcaaggctgtccaggcagtgggactccagttrttcttggcccaggtcttacccccaccccacatcccctcagggtgaaaacatcaccaatgcccctgaactgcagccgaatgctgtcacttggggcatcttccctgrgygagagatcatccagcccaccgtagtggatcccgtcagcttcatgttctggwaggtaaaggagccgggggcaagcttgccccgcccacctggaaaaccgtsgggagggattgggaccaagtcccaagcgtgtrctgaaggccacactggacccagccttcagggcacacccagctctgactcacccatgtcactgctgaygcagggtgtttatttctgggcaggggtgggaagtgatactggcagtgggccttgttctattccgggaaatgtcctgttgagcagagcccttggagagccctgttaatcttgcctstgtgtgtgtgtgcatgtgtgcgtgtgtgcgggggtatgtgtgtgtaggacraggcctttgccctgtggattgagcrgtggggaaagctgtatgaggaggagtccccgtcccgcaccatcatccagtacatccacgacaactacttcctggtcaacctggtggacaatgacttcccactggacaactgcctctggcaggtggtggaagacacattggagcttctcaacaggcccacccagaatgcgagagaaayggaggctccatgaccctgcgtcctgacgccctgcgttggagccactcctgtcccgccttcctcctccacagtgctgcttctcttgggaactccactctccttcgtgtctctcccaccccggcctccactcccccacctgacaatggcagctagactggagtgaggcttccaggctcttcctggacctgagtcggccccacatgggaacctagtactctctgctctagccaggagtctgtgctcttttggtggggagcacttgcgtcctgcagaggaccacagtgggtggcacctcctgagaaggcgaggagagtggttgttgccaactaagccctcgaaccaaggcagcctccagagccagcctgggactcccagtgaacttacmcttggagcccgtgcagtacaggcaaaacacgcaagggcatcaggcactggtggcatcgtagaagagatgtggcaaagtgctgtacccttccacctcctagaggtgggcagctgggccccacctacttgtgactgaaggggcacaccactgccctgcctgcccacttagccgtccatggcaccagccccctggatgggcattgggctgacacctaccatgctgctttttggcacagttgtctattctgagccttgagagaaaaagtgccccttaagggttgaaggcagtctgaacccttgtgcttggtggggctcgtggccttccccttttgcctggctgtggaggcctgatgctgccccgttccctgtcagaggctaagatgagatttgccagcacaggggccccagatctgcctgggcctgtgcagcagcccagcttcctggtgtatttttcaggtaggcccttgtcctgccagctgccttcctcatcccctcgtcctgtcccagaggttatctgcctggcctggctccccacgagtcacctgcaagccccagggcctgggggcagtgactggcaggtgcagatgggctgtttcgtgtagtggaagagcagcctgatggccaagggggtggacgcaattgtgggatgtcctctttactcccttcctggcctcactggctggggcagaggggcagccgctaggagagactgaaagcagcagctaggactgaggagtgggttttattgtccttcagagctcttcaagctgtcccctctgtcatcactccctggatgtgtggggcatggttccttccctgggaaggctaagttcagttctgttttttattctatgagaacaagtcacagctgcagctgggccccatgctctgccccargcccccaaccccgcggtgctcyggcggcttcctgtccactctcggggcccttggggcctggcttgctccagggtcttgggctactggcagctcctctccttgggctcctggctgccaggcgttggtgccacttcttaaaggcctggaaccagggaggagaggaaatgctattgttgtgggctttctccggggtctgtgctgtgcctgctagagcaacccctgtacccagctccttttgtccccagggcccctccctctgccccaagcagccagccagtcttgcctaggccaaatgcacaagctcagaatagatctgatggtgagctgggaagctgtactcagagcagagcaaatgagggagggggcgctcaggacccaggccctccatgggctagtgtgagtggcagccatgcctcatgccacaccttcttcgcaaactgatggaccgggtgggcctggcctgagctggggccacaaatcaaagcaagggctccagcatccagcctgtgtgttctgtaatggaactgaccccctcccctgaaaacgaaggggccccggggctggcaagcagggaaagctccacggtgcgyggctgtggcacagacttctggaaggctggctgagtggaatgcagggaagagggcagtacctgggaaaggacccacccatcttcctgctgctgtaactgctgagccactcgcagtcgcaggatccgctgccaccacgtctgccaggcccatctcaggtgccactccctgagctttggggacagttggcagagaaggcctcttgtgctcacgctcccccgcagtccccagcccttctgcctttctcccccgacactgctgcaccagagtgaaagggctatggcaagggggtgtcatctgaggagtattaagaatgcagattcctgggcctgtcccccaaggttttggagtcagtaggtccaagggccatacttttgagaggggtttgggttaagtatgaggtgaaatgggagatggtcagtgtggagaggggtgcacccactcaccagggtccgcaccagctgctctgccccttgggcatccacccagtgctgccatgccactgccaggcacctggcctgctgggaaccccgcagcccgtgaagcagtgcctcgaggcaccggcgctgcaggtacttcctcctgatggccaagagcatcgtgacccttcagggccagaaggagggcagagccatgggcctgggcctgcttttccaggatcctgcaggaacgagcactggccagagagggcccagctgtagccatggctcaggcaagcccctcagcccttgcccccatccctcggacccaccaaactgcacacacagctcctcttaccgtagcctccgtttatgggccttgctttgggctttgsaggctctgggctcagggctggagtgcgctcttggtccctggtccctcgtccacaggggcaggcctgggacccagctactctgtccaggccactgtggccagagctggaaggcagggcagagggaatgttccctgcaccctggaaaggggagttgagtcacaagagkttaaggtgggtccaggaaggcagctgctcttagtgcccgcytaggagttgagtacagtgaggagggtggaggaaggtgctgagcttagccttgtgccctgcccccatctccccaggcctccagcctctcmcggctgcctgccrcccaaagagaaatcacaggggcggggcaggaatgcaaagtgttttctcagaacagctgaaacattccgaagagggaatggatggggagaatggtcaatacacataagaccgtgtcccaaggagctgatttccaggcccctgaggactggagaccgcttcacccctgcacttcagacaccgtttgtcccccggggcaaggtctccttactctgagcccaggccgttccccttggcttcctccgtccacccaggctgcactgcagtgatggcgcgggaggcaccagctctgtggcctgtgtccagcagctgygggtctgaaggartagccagagaggagcacctgaaccccatgggcttggacttcctggggccccgctgggatttcttcgctgctctagctggcaggacacatcccggcctcttcttccacccattcccccatgtggctgaagacattccaacaatggggtgggcccataatagttagccctcagtcagttcccggagcacagccctgggagggggctatttctctccccactgaaaacatttcaaagctgagttacttgtctgaggcctcatccctcggaagccgtctgactccagagtctgagcccccggctagtaccctatagagagggggctctccaaaggggctgctggggcatgtgtgcctgtggcagaaaagaggagaccctggaattcagcaccctgggtgccattcccagcgtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcagrtagatcgcttgagcccaggagtttgagacaagccctggcaacatagtgagatcccatttctacaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaatgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactcctctgcttcagcctgggcaattgagccagactctgtctcaaaaataaacaaaaaaacttgacaaaaaaatgctactgtcctcgtgtacctattctgatcctcaactgcaccgtgagaaagcatgcatttcaatgtctccctaacaggctgtgacccaacatgctggtctttgcggccggacctgcagtggcctggcactcgagaggtgccaggttcatctttgctgatggattcagagttgcttgtcagaggctgactgagaactggggagaggtggtgcatacgaggttgctgggcccctggggaggcatccagccatgctgccaccacgggctgaatcaagctgattctaaggccggtggtccgagggtcatttttggacctcccgccctgcctaggctcccttcacctgtttccaaggggctggggcgtccagcagcaggctccccctgctggccatccggggccagagcgtgaggtcagtctggggcttggggcgtaccttgccggcccctggcagtcccagccgcaccctgagctgcactgtccgcaggaagcgcctgagctcagccggccggagctgggtgaggatggctcgctggacaccgccgcgcaccgccgactgcaccgaggcctctaggaccctgcgggagaggaaggagtctgcagccagggccatcaaggccaggactctctgcagggagcccccccagtgccctgcgggagggggccttctgggcccagccccaggctggggcccacccacctcccacactcccttttctggagggagaatctgggtaaacaggatggagagcgacctggaaggagaaaatcacagacggggacaagcatcctgtttaggggcagagaggggacagtcctgccagtgccactttgcctccccttccctggcaagagcgcgtttatggcgcttgctgagtggctggctgtgctggtgactgcaaggcatgaccattagagacttccccaaggaggggacacacagcaagaggcggtgccaggatgtggcccaggactagatggccagggcggcctctccctgtcacccccaaccaccctcttgagcctttgccctgccacccagccatgaattacgctctacccctgccaaaaacaggcttgaggcctgagctggaagcacagagtggggctgcacttagaccacagcactcaccaggctcgcggcttccaggaagcatgggctcggctgacctggccccgacaggactcatgcacccacagagcccagcaccaagtccagcactgggctgcctgggccccagcgctctctcctgcctgctgctgggcctcatggtgcatgcccggggccactggccatgctgggaaggcctgtggggcccgggccttcttctgctgcccatcttcctggccttgctgcccgcagcttctccagcgggcaagggaggcctgggccacacgctgctcctgtgccccggctgccacttcctgggcttcccgccatgtggcaaacacagcccccagtgctcttctcctcaggccatcctgaaaggcttgatgctgggcccggagcacccccgtgtctcttacaacctcacaccaggcctggaagtagctgcaaaacagacacattgggccaggtgtggtggctcatgcttgtaatcccagcactttgggaagccaaggtgagtggatcacctgaagtcagtttgagaccagcctgaccaacgtggtgaaaccccgtctctattaaaaatacaaaaattagccaggcctggtagtgggcacctgtaatcccagctacttgggagtctgaggcagaagaattgcctgaacccaggaggcagaggttgcagtaagccgagatcgcgcaagtgcactccagcctgggtgacaagagtgaaactccatctcaaaaaaacaaaacaaaaacagatgcatgggagggcttgtctcgttctcagagtcaaaagtcacatttattcaaagttacacttgcaaatctcccacaaaacagtaaacgaccagtaacaggtgaaagcactggctttccatcttgcaacctcagcctcagagggcaggggctgccctgcgagggggatgggaaccagcagtatgggttcaagtcccacatcagccatgccctgcctcccatcacatgcccaggtggttggtgagggagaggaacaccatctctcactcagtgagaagccaagaaaaaaaaccatctacggccaggcacagtggctcacacctgtaatcccagcattttgggaggcagaggcgggcggatcacctgaggtcgggagttcgagaccagcctgaccaacatggagaaaccccgtctctactaaaaatacaaaattagccaggtgtggtgccacatgcctgtaatcccagctactcgggaggctgaggcaggagaatcacttgaacccgggaggcggaggttgtggtaagccgagatcgcgccattgcactccaacctgggcaacaagagcgaaactctgtctcaaaaaacaaacaaacaaacaaaataaccatctacaccctcagatgcaaaagcacagacgtcagccattctgtagccaacagttcactgccccacggggacactgaacattcgcaaatttgtactgaactgtgggaggagccattctgtgtcctccgcttggttttacaatatgcattcatgaactgtatacatgttccaccagaacatctttacttaaatgaagatttcactctcttctcttagcgacagtgtacagcagaattctccttgctgtaactcctcacaatgggcgttatggtagatttccgaggagtggatttctcctcctttttttttttttttttgagatggagtctcgcactgtcgcccaggctggagtgcagtggtgcaatctcggctcactgcaacctccgcctcccggattcaagtgattctcctgcctgagcccaagtagctgggactacaggcacctgccaccatgcccgtctaatttttcatatttttagtagagatggggtttcaccatgttggccaggctggtctcgaactcctgatctcaagtgatccaccttcctcggcctcccaaagtgctgggattataggtatgatccactgttcccagctgatttctcccatcttaatcatatcctctaaaaccaaagaactgacctggccaggagctggactcccggggcttgttggggccacaggttaggggtggggtttgccaccactcccaaaataggtaataaggtgtcagtggtcatggccctgtgtttccaggctaggatctcccttcatgccccttttttcccaggccacaggcctcctatctgggccaccgtctgagcttcccaccccctgggtgctctccttgctattccttgcgtggggaggaccaacaccctcccacccccaggcccacccacctctgcagtagcagctgctctggccgggtcactgtgcatctctgatgagctgctgcctgctgccagctccggaacaccaccttctgcaggccctggaggtggacctgcacccatgtctggcacttttcatgcaggaactgctgccctggggccagagagatgctgaagagccactgggtgctcaccccagcctctccccatgggcctctacgcagccagcccttcgccccctaccaggtgggaacacaggaggccaccctgactgtctgggttaaaaagcctctattatgggtgtcctgctggtgaccaggccagcccagctcatagagttgttgggtttgtttttgtttgttaattttgccacagtattttcaaatctggagaattcaggtaaaaatctaattttctatttttttttttttttgagacggagtcttactccgtcgcccaggctggagtgcagtggcccgatctcagctcactgcaacctctgcctcctggattcatgccattctcctgcctcagcctcccgagtagctgggactacaggcgcacactaccacgcctggctaattttgtgtatttttagtagagacggggtttcaccatgttagccaagatggtctcgatctcctgacctcgtgatccgccagtccgggcctcccaaattgctgggattacaggcgtgagccactgcgcccggcccaaaaatctaattttcaatttttctgtaaaaactagaagttctggaaacactggctcagtgttcctgccggggaatgattgggctgcataagcagctgtctccagcggacaggacatgactttctagaaccaccacagccctgcctgccagctcattaatgcgatatgtcggtgtagtgggcagcctccaagacagcatcctgtgttcgtgtcctgggcaatgccccgccttgaatacaggctgggtttactaatttgcttttaacagacagaatttggcagaagcaatgggatgtcacttctgatatcaggttataaaaagactggttggggctgggtgcggtggctcacgcttgtaatcccagcactttggaaggccgaggcgggttgatcacttgaggtcaggagttcgagaccagcctggccaacatggtgaaaccccatctccactaaaaatacaaaaattagccaggtgtggtggcaggcgcctgtaatcccagctacgaggggagctgaggcaggagaattgcttgaacccagggggtggaggttgcagtgagctaagatcgcaccactgcatgcctgggcaacacagcgagatcgtctcaaaaaaaaaaaaaaaaaaaaaaaaagactggttgggccatgcaacagctctttttgcccagaggccaagacccagagagcaagcctgccttgggaccatccctcctcccttcactggccacattcctcagggcttctagcacactgcaccctcagccagcctctgcaaatccagtccttcccactgccctattttgctgaccccttcccacgcctcaacttctctcgccactgctctgcccgctgagccctcctcacctcctcctgggaccctccctgactaactctgctggcccctaagggcaccatgactctgcccacttctctcccaactcagggctccgaccagtgactcctagaggccaggtgaggataaggatgaagataaaggtgatgacatagggactacattatccccattttacagatgtgtaag

SEQ ID NO: 17712 - DNA, 72691 bp, Homo sapiens
gcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttcttatttcatgagtgaggtcttggggagaaggaacaggagctctgcttgtcaagtctcctcccctccctatccgctactatttactgcatgcagtagataactggtgacatggactgagcacatttgaggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcaaaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgamaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcacgaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggagggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccrgaccctgagcagcgtccactcagagcaagtgtttgcactgcgtctgcaggacaaaaagctcccmccgctgctctctgagatctgggatgtgcacgaatgactgttctgtccccatattttctgttttcttggccggatggctgaggcctggtggctgcctcctagaagtggaacagactgagaagggcaaacattcctgggagctgggcaaggrgatcctcccgtggcattaaaagagagtcaaagggttgcgagttttgtggctactgagcagtggagccctcgctaacactgtgctgtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggkttttcctttggcatctgaaaaaggcacaacctgaaagacctagaacccagtgtcggtccccaggccctttgggacaggaagagaagagccgtgtggccgcggggaggatgtcctgmggcggggctgtcctcgcggactgactggactccatctcccagcgggcgccgcggcgcggccacgcccccccactccccgcgcgcgcccggtggaggtaaccgcggccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgaccccgtcgggtgagagtctctctgagcaacccaaacagaaggtactgctgtgggtcccccacttggcacgcgacggcgctgggtcggcctggcgcgccctcccgcgcccacgggcgctaggctaggtctgtgcgcagccgctgtctcccgaggtcggccccgccccgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatrtttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacgctggaccagtctgtgctgatgagcttgcaaggtcactgcctggggaggtagaggaggggaggagagcctcctgttgtgttcacgtcagcagagatgtcatatcgctctctggttcctgtggttttactgtgagatcctgtccaaaatgagggacgaatccaaagggttggttagcatggctatttctgctgaaaaggcatagataacttaaaagtttgtgaatcctaaatctacctctgggtggagctgatggtgatgtsggacttcagcagatagatatgcattttgagctggatgcttttggaatacaggaagataggaaccagaggctctacgttagtaaacatggttgaggcaagaggcagagtcggagcctcgttggttgtgaagacaagagtgtgagttgtgggtgatgttagaggatttagtctttagaggagttaaaggtgttagtctttttggggaggggagagaggagagaatgagaaggaaaatcttagttatctttgcaatctgaataactgaaggcagtggctgctgatcagatgtgaactctggctaaaaatttatcctaccacccgtagctagaataataacaagatctcagggtccttgtggctctggaaggaaatgattgtgagtgacttgagtttcgtcagatagttgtcagtggagagggactgagatcccaccaaggctagagaggcctgatgcgtactcagtaggaggtgcttcaggcctgatctttgagattttggttggagagggctccgggttttcaatgtaaacatagattgcaaggtgtagtctagagctctggttctataaattctgttttactttaagatactttggctctcactctagtcatttctacataattcttttttttttttcgaatcccatgacaggttaactacataattctttattaaaacaaattatgctttttactcatatcccatttcatttctctatttctctcccccttggattctgctcaggaggagctgagtgcggctctgttatagtgccccacctcctgcagtttgctcatgactctattgcagttgggagaaccaagggactatttgggttcgttaagcagtggtgatacctagaaatgaatatatggcgtgctcagaaacctggtggtgktctagagatatcactatcaaaagccagaattaggacgaagtacaaactacagacagatgagggagaagacaacctaattcttagcaggtactgtcagtgggagaagtgtctctaggttcgaggagagtgaattgttatgggccttggcygactctggagtagcagctgctagcactgtgcggtcaccaagcaggggaggggctgtggctctgctataaatagtgctgggagccagagtcgctatasagataaaactgaatcctattacctgcaggtcctctactgggagcaagrgaaaggagaaagcagtattttgaggatttgagaggtattgcaaataggtcttgtttattgttaggtaggggagaaaaaacttctactcattacctaaaccaaatagggccttaagcatccagggagtgtgtatgtctgtatatatgggagtgcccgcagcagcaggtgagggaktagagggtgtgtgtgtgtatacgataatgggtttctctccgtgtgcattgaacaaggtcttaggccgcatgtagagcacagaggtagaatcctggaacactagaaatatgagaaaagaacttctactcatagaagaagtagccctaccagaaatagctgtgcagcggggtgaaacgttttatttagagaagtgtatagacacttaacacgaaataaattataattaagaccatgaaagcttttcctaattttaggacatagtttagaaatttctctgagcacstctccctgtccttgcagaaatcctggtatttctgcctctaattcatagcctctgtaatgtatagtaggacaargactcatctgtgggtrttgtattactgattctgagcctgagatcaaaatagaggagagattatgattcagcaccaagggcagagctagtagcagtggcctctgggctcctttcttgcctgaaggagggagaaaagtggtgcagattaggcaattggggcatggacattttcatttgagatcacatgaggtagaatagccagctgttattgtctgagcatggttaactagacagtctatgtggtagtttyacatcaagctgaatgtagattgttgaaacagaataattaagtttccatctagacctagaagtgcaggttagtgctagctagttgaggagtctggtttgatcctgatccaccctggagggatcctgagagtgacttcaatttttgttacaatgactgagtccagattagatggcctaggtctgtttttcagaaacagagccccaggcgttaagctggaaattaagtcattggtagggataggtaggtgaaccattatttatctacattttttttttttcttgagacggagtctcactctgtcacccaggctcgagtgcagtggtgcgatctcagctcaccacagcctccacctcctgggttcaagcgattctcatgcctcagactcccgagtagctgggattacagatgtgtgccaccacacccggctaatttttttgtatttttagtagagatggggttttgccatgttggccagctggtctcaaactcctgacctcaggtgatccgcctcggcctcccagagttctgggattacaggcgtgagccaccatgcctggcctattttttaacattcgattctgtgagctcatgagcctagacacgaggctaggcaagcgtcaagttctcctatcattagtatgaaagtggaagaccttctgacctctgcctctggccgggaagaagttgagagggatgagtcccttaggcacagcagtggatcttatcagtactttttttcctattagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggtaaccaagaagagattgacttttgtcttaatatctgggatagccataaaatctgcagttgttcccttctccgatttccatgttgctttgcatagctcatcttctcctgttattttaccctgatgggagcatcgaagccagtagggaaaaaacaaaatcaggtggattgaaagcaaaaccctgctcttaactaacatcttcttgatgtcgagcaaatatactctttatacctcagttttcttattttgtaaaaagaaaaagtacattataagctactcctctatgtatacttttttggtaatttattagttaattcactttaaaagatgttaatcatcttaaggtgccagtgataattttattgtcaaaatctccccttcgtttcagaatagatgccttcatgacagtgtagacttcacttaggttaccagctccatgcggcaggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacrccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgagrcgtacaaaggtacagtttgctgctgatgcctaatgggggaagcatttagagattccatgtaattggtctttgaggggcataggaaatttcctctacagctcaaggtccttcagacctattaagcatatttagagtatttagagttaatcttttttcttttggagacagtctcgctctgttgcccaggctggagtacagtggtgcgatctcggctcactgcaacccctgcctcctgggttcaagtgatccttctgcctcagcctcccgagtagctgggattacaggtgcacgccaccatgaccagctaattttggtatttttgtagagacaaggtttcgccatgttggccaggctggtctcaaactcctcacctcaggtggtccacccacgttggcctcccaaagtgctgggattataggcgtgagcatcatccccagccaagagttaatctttactaagcaaaagactgctgcagagttagacctctttccaaaattgtgtttggagtaatgctggaatttggtgttttaactgtggttaggacagtaagtcttacccagtatatatctttacatttgcttttgccattgtatatactttccggtcctatctgagctcagagactgggctttcttaatgatgctccgtttcccattgtcatcattagagcctctgtggtgatactgagttgcagtagggtatcagcttctgatgctaatgtgtctgattcctgctgtctgcttctcagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtgagaggcaagcttcctagacctttctaggggagaaactcttaaatatgccagtggccagaccacgagctcttagaggacagggactacatatttttcacctttttgtcttcaggaggtaacatgatgcctggtaaacagcaggtgttccgtagatgtgggttgaattaagatactggtatcatgtgggatgtatttagagggtttaccattcattagggcttatccttaattgtactgacctaattctttggaaatatcagtagttctgtttcagtgagtggtcctgggatgggcagtacaagaactaggaaggtaagggagtgatttgcatatctcaggtgactgaggatcaccattgtgcctggattgggaggtggcaggcatggtggggcagggggcagtgggagagacaaagctggagctgtaggctcgatgaagtggaaaycaagttgtaatgttggaagctgttttcttgtaaaccatattttatgttttggagtgattcttactggatggctcatgacaggtggtgctacagtcccgagactacaatgcactctccatgtctgtgatggcattcgtggcaatgatctacccactggartatatgtttcctgtcatcccgctgctacccacctgcatggcrtcagcagagcaggtgagtctcaaggcgacttccggctttctcacctctgtcttcctgagggaggaggcttaatgctcaaagaagttgtaagtgagtgctggtcctcaatcctttgtcataacttatttgtctacaaaatctgactgatttgaactgatctggtggcaaggcttatgctattttagttttcatttatcacaacaaatgttaatgactgtaggccactggctacactgcagcaggtgttacgtgtgttacgtaatacagtagttcctccttatctgtggaggacacattccaagacccaccagtggatgcctcaaaccacagatagttccaaactctatagatactttgtttttttctatacatatataccggtgataccgtttaatttatgaattagacacagtaagagagtaacagtttctctttgggcatatatttggtgttttttggagacagagtctccctctatcccccaggctggagtacagtggcacaatctcggcccactggagcctctgccttccaggttcaagtgattctcctgcttcagcctccctagtagctgggattacaggcactgccaccaccacacaccaaataattttttgtatttttagtagaggcggggtttcaccatgttggctgggctggtcttgaactcttgaccttaggtgatccgcctgcctcagcctcccaaagtgctgggattacaggcatgagccaccgtgcccagcctctttctacatatatttggcttctctttggcatatcccaattgccagcatcagtacccttgtgctttggggccattattaagtaaaataagggttacttgaacacaaacgctgagattgtgtgacagttgatctgataaccgagatggctacaggctggacacaggggtgattcatgtctgggtgggacagagcgggacagcatgagatttcatcatgcttctcagaactattgtcctgcmcttcagatatgatcaagctgcagtttaaaatttatgaattgtttatttctggaattttccttttaatattttcagactacagtttgcctcagttaactggaatcacagaaagtgaaactgtggataagaaagactactgtatacaaaaaaatgtaccatgttacctttcaaaaaatctgaaaaattctgaattttcaaatacatctggcctcaagagttttggaagagggattgtatctgcatttccttatctagaagaatccagacttgataagtgctcatgataggttttgtctttgtttctcaccttctttatcatttccacagctgctgttggctccaaccccgtacatcattggggttcctgccagcttcttcctctacaaactggacttcaaaatgcctgatgatgtatggctagtggatctggacagcaatagggtgaggttcttggctgaggcattgtagagtctagaggaggattgcattctagacccagtcctgagatatctgtttctagattcctttcaggaacgtcctaagttgttggataatttctattgcgagacttactgaaacaagtttttttaaatgctccttttaccttattagccaaataaacccttggttaggtctcagagaattacaggatttatttttgccagaattaagtgaccccccaccatatcctccaagagcagtcagacagttgtgatctgagggccattacatgtggtatagatcatctcttaatggtttccctggggtatagtttccagtaagaaactgtctttcagtgcaggcttaattaattatatgaccattctgcaatgtgaatacattcagactttggtgggaagcccttatgtgtgctcattgtaaaacttaaaaaaaataaaaataagcgtaaataaaataagtgaaaagaaaaaccataatccttttatctagagataataaccaataacattaagttatatttcatttcagatgcatatgtatgtcatatatgtgtgtacatatatcttactgtgcagttayataatgtatattcgtttatataataataatgtatatacgtcctcttatttttatttatgtaagtgaaattcctgagcaataaactctaaggtcacgtcttttatcrtttctctggtgcaggtgattgcccccaccaatgcagaagtgctgcctatcctgccagaaccagaatcactagagctgaaaaagcatttaaagcaggtrggtgaagaacgaaggaaagaaaggggagtattagatgctgtgggattcctataagaagacagctattctcagagccaatttcctatcaaacttcaagtggagtagttttcttcaccctggatgggcttaagaaaacgcgtatcccatttctgggtggcagagtgaatttctgtttttgattccaattcattgtatgctttaccatcttctaatgcttatgatgctgtataaaatagcccttcactctctgtttcttgtatgtgtgccactctctatggcttcagaacattttctcagtctttttttttttttttttttgagatgtggagtcttgctctgtcccctaggctggagtgcagtggcgcgatctcggctcactgcaagctctgccttctgagttcacgccattcttctgcctctccaggagctgggactataggcgcacgccgccacacccggctaatttttttgtatttttggtagagacggggttttgccatgttagccaggatggcctctatctcctgacctcatgatccgcctgcctcagcctcccgaagtgctgggattacaggcgtgagccactgcgcccggccgattttctcagtcttgttaggtggaagttagtagtgtggaccgtctggctgcttttatattatcttctagagttgatcctgagggttcctttcttcaaaaattcctttatttggctgggcacggtgcctcatgcctgtaatcccagcactttgggaggccgaggcaggtgaatcacgaggtcaggagttgaagaccagcctggccattatgttgaaaccctgtctctactaaaaatacaaaaattagccgggcatggtggtggacgcccgtagtccagctactcaggaggctgaggtagaagaatcacttgaacccaggaggcagaggttgcagtgagccaagattgcgccattgcactcctgcctgggccacagagtgagactcagtctcaaacaaacaaaaaaattcctttctttgagtaattcctcacatccattttttattgattgattttcttcttcctctgcatgctgaacacagtacctgaaggtaacacatgacaaagcttcattcccttcctctgccttatgtgttgtacaggaacaccagtagatarcactgtgtttatttttaggaatccctgctctcatttgaagggcctttagaaatctttttctgtgttgtctgaagtacttagtagtatctctagatgctatgtttgggtttaaatgggtcattgtgtttcatccctctcacctcagttgcttcatcactgctaatataatatgataccttgttactgcagagtctagtgggaattttaagttcagaaagttctctagctgccttcacttgctgtgttttcagtcttgatgattgctttagtatgactaatgagatggagaggttaataaatggaattatatttaattaaattaattaattaattwattwatttattttgagatggagtcccactctgtcacccaggctggagtgcagtggcacaatcttggctcactgcattctctgcctcccaagttcaagcgaatctcttgcctcagcctcctgagtagctgggattccaggcacacaccactgtgcccagctaatttgtttgtatttttagtagagctggggtttcatcatgttggccaggctggtctcaaactcctaacttcaggtgatccacttgccttggcctcccaaagtattgggattacaggcatgagccaccgtgcccagccagaattatattttaaatgtttgtaggagctaagatccttggactcattgatcctgtgttctaactcctgctattcaaagtgtggtttgtgaaccagcaacattagcatcactcgggcttgttaaagtgcaggatcactccaggcatattgaatcgggatctgcattttaacagcctcccctggtgattcttctcctcactcacatttgagaagcactgctgctctcgaccagtggtcttcacgctgccccattgagcctctgaggggccgatttagcttgggagccctgagcatttgaggctctgcttcctgtgtycttcagagcagctctgttttcaaatttccattctatataatttcacatagattccaattttaaaaaacatttaatgactataataattttgcaaacgactgtcgtggacttcagataagatcaagttgccttgagctaggttgtcttaagatggagagctacatatttcaaactgttttctaaaggctagaatattgggatttttatttcaaagatgaaaggtctgaaatgggttggccgtgatttgcaaattagcaccgttctttgttgcagaactttttgaccagagaatacgaggtagcagaccttaggaaggccttttccttggagttaagattggctagctgcccagggacgttccttgtgtaaggaattttcttgttgttccacaggccttggccagcatgagtctcaacacccagcccatcctcaatctggagaaatttcatgagggccaggagatcccccttctcttgggaaggccttctaatgacctgcagtccacaccgtccactgaattcaacccactcatctatggcaaygatgtggattctgtggatgttgcaaccaggtaagaccaagccgactgtataatcacaagttcttaaattaatttctttgctctctaagggaccttggggcagactatttctctgaaccagggttcctttttttttttttttttttttgagatagattctcactcttgttggagtgcaatggcataatctcagctcactgcaacttccacctcccgggttcaagtgattctcctgcctcagcttcctgagtggctgggattacaggcgcctgccaccacgcctggctaatttttacatttttagtagagacggggtttcaccatgttggccaggctggtctggaactcytgacctcagttgatccacccgccttgtcctcccaaagtgctgggattacagccgtgagccaccgcacccagcccagggtttctttatgtataaaatatatactatatttggttgttattttccaccttagtaaaatcaaagtgaagaaatagtaaaccacgtgctcaggatgaagagggggctgatgattctttaagatatctctcccyttgatgttggaagcctgttaagtgatggctttgggaggtgttctaagactttggatcatgggaatccttacsctatgggtctcagattatctcatcatctgcttccccagggttgccatggtacggttcttcaattccgccaacgtgctgcagggatttcagatgcacacgcgtaccctgcgcctctttcctcggcctgtggtagcttttcaagctggctcctttctagcctcacgtccccggcagactccttttgccgagaaattggccaggactcaggctgtggagtactttggggaatggatccttaaccccaccaactatgcctttcagcgaattcacaacagtgagtctacctgccctctgctccgctctgccttgtgcctctgtcctcctgatggactttgatttttcctttgctaatgtttgacctgtgccttctatcctggctctgctttagactttttcctgcctttctttcaggcgttgcttgcctttttttccttgctgctgactktctgttcttttccctcatggggtagatatgtttgatccagccctgattggtgacaagccaaagtggtatgctcatcagctgcagcctatccactatcgcgtctatgacagcaattcccagctggcwgaggccctgagtgtaccaccagagcgggactctgactccgaacctactgatgataggtgagcatccttagggcagcaaaaaggttttaaaggtgaggaggctctcactagcccttctttagcacagagaaggcaaagtctcataggcttcccatatcagtgtttttaattttattttattttatttatttatttttttgagacggagtctcgctctgtcacccaggctggagtgcagtgacgcaatctcggctcactgccagctccgcctcccggcttcatgccattctcctgcctcagcctcccgagtagctgggactacaggcgcccgccaccacgcccggctaattttttgtatttttagtagagatggggtttcaccgtgttagccaggatgatctcgatctcctgaccttgtgatctgcccgcctcggcctcccaaagtgctgagaatacaggcgtgagccaccgcgcccggccttatttatttatttttgtatgtatgtgacagagtcttgctgctctgtcacgcggtctggagtgcagtggtgccgtctcagctcactgcaagttctccctcccaggttcaagtgattctcctgcctccgcctcccaagtagctgggactacaggtgctgccaccttgcctggctaatttttgtatatatatattttttgagatggagtcttgctctgtcgcccaggctagagcrcagtggcgtgatctgggctcactgcaacctccgcctctcgggttcaagcgattctcttgccccagccacccgagtagctgggattacaggcacatgccatcacgcccagctaattttttgtgtttttagtagagacaaggtttcmccatgttggccaggctggtttcaaactcatgccttcaagcaattcgcctgcctcggcctcccaaagtgctaggattacaggcgcgagccactgcacccggctactttttgtatttttagtagagatggtgtttcaccatgtttgccaggctggtctcaaactccagacctcaggtgatccacccgccttagcgtcccaaagtgcttggattacaggcatgggccactgtcccggcccccatatcagtctttatgctttggttgactgtttttcttggcttctttatttgatttgttccctggccttgagttcggagtgctcccccttttatttttcctsgtgctgatkgtaggtgttctccctgcccctttctgttttgtttgttttttatgcacttcactctgcagtggcagtgatagtatggattatgacgattcaagctcttcttactcctcccttggtgactttgtcagtgaaatgatgaaatgtgacattaatggtgatactcccagtaagtgtgcttggggagattggccagccctgggcaggggttgggggcccaaggatggagtggtctgtacctgcctcccttggattttggcagatgtggaccctctgacacatgcagcactgggggatgccagcgaggtggagattgacgagctgcagaatcagaaggaagcagaagagcctggcccagacagtgagaactctcaggaaaaccccccactgcgctccagctctagcaccacagccagcagcagccccagcactgtcatccacggagccaactctgtaagtgaggagcggtggatgagtgagaaccatggcctgggatgtgggcctcatctattaggaaagccaggctgtagctattcatttgctgcttctcacacaattttctcatcttcctcttcatgggccctagagcttagagcctaagagacctacttttgaccccaaaaggaggtcatcaggctttgttcagggtacagctatgatcccccttatatagtttgtggggacagagaacgggtgctacagagatcatttcccacacattccttaggctagaaatctgacaggcctggtccagccctgccaaactgggattacaggaaggtaccattgggcaccaggtaaccacttttaatttcatgcggcctttaggaacctgctgactctacggagatggatgataaggcagcagtaggcgtctccaagcccctcccttccgtgcctcccagcattggcaaatcgaacrtggacagacgtcaggcagaaattggagaggggtcagtgcgcyrkygaatctatgacaatccatacttcgagccccaatatggctttccccctgaggaagatgaggatgagcagggggaaagttacactccccgattcagccaacatgtcagtggcaatcggtgagagcctgggcatcccttctagatgggtgactgaaggacctcacctcagtggaccctgggcaagggttaatcagaaagtctgagaagtctgaatgctctcgtggtcctgccatccccagaggatggtgttctgatccaggggcttaggaattacgggaagggagtggcaactgtagtatagcataattatggcccatactcccaagatcaggtacccctgcctggggatcataggtgcctctgtgcattcaagggctcaaaagctgctgcggcccaacagcttgagactggcaagtgactcagatgcagagtcagactctcgggcaagctctcccaactccaccgtctccaacaccagcaccgagggcttcgggggcatcatgtcttttgccagtaagtgccttcagctgtctctctcactcctgtgttccattttctctacagcagagcctgactatggcaaatgttgcttagaacttcacatgtagggctaggttggcattagcaagccctaatccagtcatttgggtgatactgaataaggcgttttcaagtgaggtcagtaaaggacagggacagattagtcattatcattatgcctggacatttcagtctatttcaggtaagacagctggatgggtaactggaaaacaggcagtaaattcaaaatcacacacttgtacttatattttgtggaaatactctggtcaaatttgatttgagtccatatctggtatcttctttgcctcataacggactcttccatgaatgtgctttgaaatcgatatgagattgaattttgtgcttagatagtattcccagcagtgcagggtcgtatcagctaaagattgaagacagaccatggactagagagagcgaacgtagaggatccctgtgattgtgagtttcttcagcagccagggagggacagtgccagcttcagaccagaagcctgttaactgccagctttcatgctgtgtagcagtggatgagagacttggatattatcatgtgaggtggacagagaaagctgttactgggttttggctgatcctggcagtggctccattgtttgcctggagttagacttgatcctttctaagacagatcagagatgatctgatccaccaaactgggattgtgtttgaaaaggagggaggtgcagatgctgatagtcattagtctactgctttgattacttactctgccaagtcatcgctcttgcaccctccccttgataggcagcctctatcggaaccacagtaccagcttcagtctttcaaacctcacactgcccaccaaaggtgcccgagagaaggccacgcccttccccagtctgaaaggtaactacagccttccttttgccaagccaggtttctccgggagatgtttcgggctgtgggttcatgtcaggagccctgcatctgctgaatcctttgacctggttgtygtccctcatgttgctcctcatggctttcaccgcacatcctgggctctgatggttgtcagatggaaaccatctttgtagctagagacggccctgttatgtcatttaggacaatggcaactgtgggattactgctgcttcgcgggaggaccctgtcagggtatatgattaacatagggatcatcagctgcccccagtcgtctgctgggttgccactgcatgaacttagggcaaattccgtgccaaggagctggcccaccagagaatggttatggagagcctggcagcgttcatagagcacagcctctcacctctcacgcactcataagcctgtcaacccagggcttaatgagtgcgccaggtagtattggttagtttctaggggcagttaaaaccttatgtgaaagccaggcgcggtggctcacgcctgtaatcccagcactttgggaggccgaggcgggtggatcacgaggtcaggagttcgagaccagactgaccaacatggcgaaacgccgtctctgctaaaaatacaaaagttagccatctggtgtcacgcacctgtaatcccagctacttgggaggctgaggcaggagaatcgcttgaatccaggaggcggaggttgcagtgagccgaggtcgcgccactgcactccagcctgggtgacagagcaagactccgtcttaaaaaaacaaaaaacaaaaaacgaaaccttayttgaattggtttgtgctatctgacagtttcaggggcttttctgaatttgattttttattttttttattttctgagacagtgtcactccgtcacccaggctggatggagtgcaaggtggtgatcttggctcactgtaactgccgccatccaggctcaagtgattcacatgcttcagcctcccgtgtagttggaattataggcacataccacctcgcctggctaattgttgtatttttagtagagacggggtttcaccatgttggccaggctggtcttgaactcctgaccttgagtgatctgcccaccttggcctcccaaagtgccaggattacaggtgtgagccactgcacctggcctgatttttttgttttctctggatggtatgacgaaatatttaactgtggtaggaagtgcagtgagaaacatgtattttttttttttttttttttttttgagacaagagtctcgctctgttgcccaggctggagtgcagtggtgcaatcttgcctcactgcaagctccgcctcccgggttcacaccattctgcctcagcctcctgagcagccgggactataggagcctgccaccacgcctgcctaattttttgtatttttagtagagacaaggtttcaccgtgttagccaggatggtctcgatctcctgaccttgtgatctacccgccttggcctcccaaagggttgggattacaggcgtgagccaccgcacctggccaacctcatgtattctttaactgacctctcattcctagtggtaaaaaatgtcaggttacttgggtgcagtagctcacacctgtcatcctagctacttgttaggcagaggcaggaggttcatttgagcccaggagtttgaggtacagtgagctataattaggccagtgcactccagcctggacgacagagtgaaaccctgtctctaaaagaagccaacagaaacaaacaaagttgtcaggagtctaagacatgttcttaggtgaggatgggaacattggataaatgggcaaaaggacatcagagctggcagtgaaaggagcgaactagcactgccagggaatccacatgtggccgggtaggctaaggatggaagggtgtcagtgtcactggccttcatttggtacatttgaagagaagagcgattgaaactctttcattgcatgctgatgctttgtcgcatttgctgcacttaccctctcacccatctcccatcctcataccctgaccccactccccacaacagcatctgcaagatgggttgcttccctgcacataccctcaggcccctggccctctgtgctggatgttttctgaaaaccagcggtccctgtttcatgcatgtgtgtgttcagtacctgaaggctccctgtgtcatttacccgcccctggcttgagaggccagttttaagggtggtcttttcttagagccttggttgtctcctggtcacttggcttccagctctgaggtgcccaagaaccaaggttatgtgcattcctcaagctttgggagaatgctcagattatctggcttactgctcctcggaggggtagaggggttgcggtattgtggtacacctactaattgtgtattttgtgtcccagtatttgggctaaatactctaatggagattgttactgaagccggccccgggagtggtgaaggtgggtcttgcctgtgagctgtgcatgatcttttttttttctctagcatcttctgtgcctgcccgagggccatccttctcatggagcaagcagcgtcacatgagtgacctgcttgccccgtcccccgtgacgcccatgcttgcccatggggcttgctgctggtgcatgtggagtggcctgagtctccatccccacctcctccacattgccatggctggtttctacctacgtatgatgccttggtgctaccctcacccagcccttctgaggaacgggcatggaacatggctacttagggctgtgctggcatgagctcctgtactacaatagtgatgtctctcattcctgccttccctgccacaggaaacaggagggcgttagtggatcagaagtcatctgtcattaaacacagcccaacagtgaaaagagaacctccatcaccccagggtcgatccagcaattctaggtaataaatggtagagctgttttaaaagttctcaggcagaggtggggtggttcctctacagaactttagggatgctcaagagtgggagagaagctctcaatggggtagatgtaatcaatttcttgccagcacttctcattctggcttgatctccatgcaactgaaagcttacagtgttgaggggggttaatcagcagcggtgggtatttggacaaatcgcgtgctccagagaggtggggatgtggtgcacttggacattcagagacatggctttgtgttttaccyctggaggcagacatctagtctgggtgaaaggtgggggktgctctgcaaaggagctgatgaccacagaagcggtgtgtggaccctgtagtgagaaccagcagttcctgaaggaggtggtgcacagcgtgctggacggccagggagttggctggctcaacatgaaaaaggtgcgccggctgctggagagcgagcagctgcgagtctttgtcctgagcaagctgaaccgcatggtgcagtcagaggacgatgcccggcaggacatcatcccggatgtggtcagtgttgggggtagggaatcggagtaactggagagagggatgtgaacaccacaggcaatttgccaaygctagcccctgggttattgttgcaggagatcagtcggaaggtgtacaagggaatgttagacctcctcaagtgtacagtcctcagcttggagcagtcctatgcccacgcgggtctgggtggcatggccagcatctttgggcttttggagattgcccagacccactactatagtaaaggtagggatcgtacttgctgggcaccacgccatccctaactctgccacttgtctcytgaagagaaaatatatgtgtacccaggacacgtttcccagtgccacgctgcttcccattaggctttgggattttattttctaatgcatgtttatacgcagtgggtattctttgttacgaaaaataagacatcagctcatstttccttgaacttcttccattccgcaccctcctgtatcctggctcctcccacctcatatctgcgccttgattcctactcactacttctcttgacctcttgatatttttccctcagaaccagacaagcggaagagaagtccaacagaaagtgtaaataccccagttggcaaggatcctggcctagctgggcggggggacccaaaggctatggcacaactgagagttccacaactgggacctcgggcaccaagtgccacaggaaagggtcctaaggaactggacaccagaagtttaaaggaagaaaattttatagcatctattggtacgtrtcagtgtgtttggtgtggtggaggggtcctggcttcttaaatatccctttctcctcaattcatccagaatcctgcctttctctgccccatgctttgcttcttagagagggaagggggcctgtgtccatttctggtggtgtttctttgtacttctctagtctttatgcttcatccacagccaccccccaccccgtatcttagatgaagaatggtaagttttgtttagagggcccaatgaggcttactgcagggggtgtgagctgtactcctggcccctccttttatttacgtctgcatttcttcacatagtggagagaattcctggaagtgctcaggargtttatagatgcatytttgggctataaaattatgacatttgtgtctctgaagccagtgtcctcccatccaaccattatactcctctggaatgtgctcctctggggcatgcctggcaaccccatttccctgggttctggatctttgaggtataggtttccaagtcagttctttaaatgcttcttcactggacttgattataatctcgtttacatttggtgtttctccrttcccacaaaggcagtgccttagtgagctttctaggcatcacctctgtttggctcactccctgcttgaccttgagtcatygaggttggatctttctttttctggttctaggtccctaggcactctgcttccagctgacatctcattgccatggccattagcagttgccatatgctcccataaatggtgacatggaaccagattcctttttaggggagctacacttccctagccagcagaatattattctagtagcagtcaactcctggctttctcctgcctcatgtgatgttgtagaaaatgtactgacctgctagtctggagatctggagttttagtcccatatcagcctccaactaggaatgcaactttgggcaaataacttcacctctcagggtatctgtctcttcatctgggaaatgaggaaatcatactaagtacactctgaagttccttccaggaaaagaattgctgtggttgccattctgtctgcttttccctatgaagatgctggtcttgaccattttatgttctctgtcacctcaactggaggcatttttccagatcactggtgggtagggcaggtaggggtgagttggtttcttgaggagcaatgaggagggatgctaactgcctgcatgaattggcctttgttcagtccagtgaatcaagcaaagattggtgttcttccttctgaaactctggctgcttgaggtgttcatctgtctcatctggaatctgaaaaattgcccttccccagctcatttggtagagagagtgtgtggcatggtgggagtttaaatggatcctaagttacatgatcttgatcaagtgctccagcctctttaggaccagttcctcatgcaaaaatgaaggagctttgttaagggcacttccagctctaacattctgcagggtttttactgccacattgggattggaattagaaatttggaatctgttcatgagtttgggtggaggggttagatctcttgttttctgccccttctccccatgaagatatctttgtatctcttggttggtaatccagtgcctgagactgaatcgacttgggtgggtgggtttccatttcgtctgtctgaccagcctctgactttctgtctttctctcctgcttgcattgcatctggggtagaattgtggaacaagcaccaggaagtgaaaaagcaaaaagctttggaaaaacagagtaaggaacaaatgccctttcctgttcccaagtcctccatacctgccaactccccaggcccagttggggcaggctccctttgtcagccccaccccaaatttgctcttagagcgtgtttggaatggcagcaggtaggtagcatgtgactcctaggtgtgtgtaggccgcttctttccccctcccctcgtgtcaatcaggctataaccaggtgtctactgaatacaactccccagaacttggttctctgttgcttcagagttggtggggagaatgtttgcctattttagtgccccccattggctgatatctcccacacctgttagaaggcctgtgggcacagttggcagagatggttgctgtccctccatgttgagtctgtagctgccccactctctggtggcttgcctaggcacgctttcttgctttctgtcattctgtctttctgccataccattgtgggtgggtgggggacaaggggggtggttttcatctcaaacatagaagttgtaggatggaggtaggcagtgcccaccaaaacagctggtgtttcttatctcatcgggcccaaccttttctacctcctttagacacatttgtttgggaagcattaagggacctggggaccattaaatggtttcaggtaccagtgaagctcagactcttgagtgccatggaatgtggtttagacatttgttcgtggagcttttctttttttttttttttgagatggagtcttgctctgctgctcaggctggagtgcagtggtacgatcttgcctcactgcaacctctgcctccagggctcaagcaattgtcgtgcctcaacctcccgagtagctgagattacaggtgtgcaycaccacgcccggctaatttttgtattttttggtagagacagggtttcatcatgttggccaggctggtctcaaactcctgacttcaggtgatctacctgcctcagcctcccaaagtgctgggattacagtcgtgagccaccatgcccagccttgtggagcttctctgttttaagatgatttgctcagaattttctcaggttgagaagatggctggagaacccattgagaccaggtctgatttgtcctacttggttcttaaggcatctggggwcctctttttccagtgggtcctgagtggggggtagtccttggaaaggtgactaggatgggctgaacgggtctgggaacagcctgtgctgccgtcccaccccctttaccagcctgcccctagcctttgtgcacggagtaacagaagtcttcccctactcagggcctgaagtaatcaaacctgtctttgaccttggtgagacagaggagaaaaagtcccagatcagcgcagacagtggtgtgagcctgacgtctagttcccaggtttgtgacaaccttgttgaaatttgcaagtattaaatatgctgtctcagaatacttctttaagttaaaatagaacagtcagacagccgggcacagtggctcatgcttgtaatcccagcactttgggaggccgaggcgggtgggtcacctgaggtcgggagttcgagaccagcctgaccaacatggtgaaaccccgcccctatgaaaaatacaaaattagccaggcatggtggcgcatgcctgtaatcccagctactcgggaggctgaggcaggagaaatgctttaaccggtgggcggaggttgtggtgagccgagattgtgctgttgcactccagcctgggcaacaaaggtgaaactccatctcaaaaaaaaawaaaaataaaaataaaaataaaatagccaggtgcggtggttcatgcctgtaatcacaggactttgggaggccgaggcaggtgggtcacttgaggtcaggagttggagttggagaccagcctggccaacgtagtgaaaccccgtctctactaaaaatacaaaagttagctgggtgtggtggcgggcacctgtaatcccagctacttaggaggctgasgcaggagaatcactggaacccgggaggcagaggttgcagcgagctgagattgcgccactgcactccagcctgtgccgcagagtgagactccgtctcaaaaaaaaaaaaaaaaaaaaaaaatgaacaacctcaaaacaatataaataactaatgataagggaattattaaataagtataatagatccatgtaatgcaatattagtatccattaaagattgtgttttcaaaaatttagtgacatgggaaactgtttaacaaagctacctatagtgtgactccaattttatttttaaaatgtattgagaaaaaactgaaaggaaatatactaaaaacagtggttaacgtgggaggtagatttacagcttgttcttatttccttattctttcatgtattttctacagtgagcatgtacttctttaacgcattgttttttgtttttttgtttttttttttgagacagggtctcattctgtcgctgcagctggagagcagtggtgtgctctctgctcactgcagcctcaaactcctgggctcaagtgatgctcccacctcagcgtcctgagcatctgggaccgcaggcacccaccaccatgcctggctaagtttgtgtattttttgtagagatggggtttcgccatgttgcccagcctggtctccaactcctgggctgaaatgatcctcccacctcagcctcccaaagtgctaggactacaggcgtgagccactgtgcccggcctatttcttttttttattacataagttgtacatattttatattctggaaacaaaagttgctcgtgacttctctaaggatgataacagaagggtggggatgaggagaaagaaaaaggtacagtattyctgtgggaaactgagaggagattggacacctcccctaatgttcctgtgtcttgtttcagaggactgatcaagactctgtcatcggcgtgagtccagctgttatgatccgcagctcaagtcaggattctgaagttagcaccgtggtaggggaacaccacactggcatcttggtgggtggggtgtggatttcccctttggaaaagggtgctactttctctttggaggctgctctgagtctcaggtcagcatggttctcatggtggagatgtttaccatcataggtgtgtgtatacgagatttcacccagagcttctcatcttataaagaaggtacttccagaggctatctgacacacttttgaaatttaatacttttttatggtggcagggagctctaacagcttggtatttctggggcccatccctggggactgtctcttactaccttttttcctttccaggtgagtaatagctctggagagacccttggagctgacagtgacttgagcagcaatgcaggtgatggaccaggtggcgagggcagtgttcacctggcaagctctcggggcactttgtctgatagtgaaattgagaccaactctgccacaagcaccatctttgtaagctttgtttattaacaaaagaaaaccatttctttaatgggggagggaagcaggcaagaaaagaatgaaagttaagagacgctaaagaggtaaaggttaaataaggaagaggtaatcttcttatatttggctttaaggaaaacatttcttaaggctttgttcagagtcatttgactcacaatctggggcttttagaaccctctcctgaatcattgatgagttaggctccgtgcccagtcacgtaagggctttgaatcctatgtagtattaacccccaggtttaacacaggcaaagtaatacctttgtggcaatgtcaggacaattacagctctcgtttagtaccagtctgcctatttctatggactatccagttttattttggtcactgctctatttataaataaaatagcattttattttagtatattcctaacagttatttgaagttttcattcattaataaacatccatgaagtgatttactaagtgccagattttgtgctaaagaaacagggatgaaaaaggcatggtttctactcaagaagtytgtgattcactatattgctgtgagtagtctcttctaataggtgaggggaacaatgccttaggaaaaaagaacttccctagatcacacagtaagcccatgatcagctggaaggagatgaattctttttagtccttgccgtagacatctgttttttgttgtttttttttttttttttttttacacagggtctcactctgttgcccaggctggagtgtagtggcacagtcactgctcaactgctcactgcagctttgacctgttaggctcaagtgatcctcccacctcagcctcccaagtagctgggactgcaggcatacaccaccatgcctggctaattttttagttttttgtagagatggggtttccctctgttgtctaggccagtctcaaactcctgggttaagtgagcctcctgccttggcctcttaaagtggcatgagccactgtgcccagcctctgctttttaatgtgtatgtgcctctataggctgtgttaaaacactgatagacttgttactttattaaacagagatgagaatggatgttctctacaagagcttatacgcataggtccttatctttaaggcctatggggagaaaggaagataaaagttaaatgaaaccaactatttaaaactggttatcattcccacccccagagccttctgtatgtgtgtttttaatagagtcagtgacctcccagagtggagattgggaataggactgagaggctactcaagttaatgggccttaactctctctcagtctgaacagactgattggctgattgagtgattgatttttcttttgtgctgacagtttattaggggttttcttttcttttcttttttttttttttgagatggagtctcgctgtgtcacccaggctggagtgcagtggtgcgatctcggctcacggcaagctccgcctcctgggttcacactcttctcttgcctcagcctcccaagtagctgggactacgggtgcccgccaccacgcccagctaattttttgtatttttagtggagatggggtttcaccatgttagccaggacggtcttgatctcctgacttcgtgatctgctcgccttggcctaccaaagtgctgggattacaggcgtgagccactgctcccggccaagggttttcaataatgttttcttttcttttctttctttctttctttttttttttttttttgagatagaatcttgctctgtcgcccaggctggagtgcagtggcgcgatctctgctcactgcaatctccacctcccaggttcacaccattctccttcctcagcctcccgagtagctgggactacaggcgcccaccaccatgcccggctaattttttgtatttttaggagagatggggtttcaccgtgttagccaggatggtatcaatctcctgaccttgtgatctgcccacctcggcctcccaaaatgctgggattacaggcatgagccaccgcgcccggccttctttacatattagttcaaccttcaccacaaaatctaaccatggatcgtaaaaattaaattggcaacggggctagcctgctatacttcctgtttacttttagatgcttttcaaaccaataaggatgacatttgtggtggaaggagccagagtaataggaaaattacttctcttcgcttagaagaaaatcctccaccttgagcatcttctgaactttttactataagacatctcagtgcttgcttgtactcttcagccgcataactgtgaagatagcaaccatcagtttctcataaatggaagcggcagtgagaaccgtctacagcagtttggcttcaaggcctgtgtagaggcccattattccaaaacacctgttagccatttgtatgtcttcttttgagagagatctattcagctcatttgcccatttttaaatagattatttgtgtttttttgctgttgagttttttctttcttgtatattctggctattaatcccttgtcagatgaatagtttgtaaatattttctcccattctgcagactgtctcttcactcatttcatcgtgtcctttgttgtgtagaagctttttagtttaatataatcctgtttttgcttttgcttttgttgcctgtacttttgaggtctccataaactttttgcccagaccaatgtcctgaagcatttctgctacgttttcttctagtagttttatagttttgggtcttacagttaagtctttaatccattttgggttgatttttgtatatggtgagagctaaggggtctagttttatttttctgaataatggatatcaagttttccgagcagcatttattgaagagactgtccctatccccagtgaatattcttggttcctttgtcaaaaaacagttggctataaatatatggatttctttctgggttctctattctgttccattggtctatgggtctgttttttatgccagtagcatgcagttatggttactatagctttgtcttatattttgaagtctagtagtgtgattcctttttgtccaggattgttttggctatctggggtcttttgtggttccatatgaattttaggattttttttctatttctgtgaagaataccgttggtattttggtagggattgcattgaatctgtagatcacttttggtagtatggtcattttcacaatattcgtccaatccatgaacatggtatatctttccattttttccctatactctttcttacatcagtgttttttatttttcctcatggagatcttttacctccttcataaaagataaatttctcctaagaatttattcttagggcattaatttgtggytatcgtaaatgagattgccttcttgatttctttttctgctattttattgttggtatatagacacactactgatttttatgttgattttgtatcctgcaagtttattgaattcacttattagttctgagttttctagtggagattttagggctttttttttttttttttttttttttagatggaaccaggctggagtagtgcagtggtgcagtatcagctcactgcaacctccacctcccgggctcaagcagtccttccatctcagtctcccgagtagctgggactgtaggcatgcaccaccgtgcccagctgatttttgtattctttgtagagacaaggtgttgccatgttgcccaggctggtctagaactcctgggctcaagcagtccacccgccttggccacccaaagtgctaggattaacaggtgtgaagcacaacacccagcctaattttagggacagtttgacttccttctgtccaagttggatgccctttatttctttctctggccaattgctttgattagcatttccagttgaataaaagtggtggaagtagacatccttgtcttgcyacagattgtagaggaaaaactttcatctttccccattcagtatgatgttggttgtgggtttgtcatatatgacttttattgttttgaggtatgttcgctctgtacctaacttgttgagagcttttatcatgaaggaatgttgacttttatcaaatacttttgtatttggtattcgttcttctttaaatgtttttagaattctgcattgaagctattgggtcctgaggctttcttttcttttttctttcttttttttttttttttttaagacggagtcttgctctgttgcccaggctggagtgcagttgtgcgatctcggctcactgctacccccgcctcccgggttcaagcagttctcctgcctcagtctcccaagtagctgggattacaggcgcccacgaccacgcctggctaatttttgtattttcagtagagacagggtttcaccatgttggccagggtggtctcgaactcctgacctcaagtgatctaccccccscccgccccaaagtgctgggattacaggcgtgagccactgcgcccagctttttttctttgagacagagtctcgctctgttgctcaggctggagtgcaatggtgtgatgttggctcactgcaacctctgcctcccaggttcaagcaattctcatacctcagcctcttgagtagctgggattacaggtattcaccaccatgcctggctaatttttgtatttttagtagagacagagtttcaccacgttggccaggctagtcttgaactccaggcctcaagtgatctgcccgcctcagcctcccaaagtgctgggattatagrcgtgaaccaccgtgccctgtgatgggaagctttttattacagattcaatctcattacttgaaattggactattcaggtttctgtttcttggttaaatcttggtaggttgtctatgtctaaatttatccgtttctaatttgttggcatatagttatagtctccagtgattttttgtttttctgtgatgtcaattgtaatgtttacttttttgtttttggtgttttcttggtggaggtcttttcactctctctctttttttttttttggttagtctagctctaatggtttgtggattttgtttatctttacaaagatgaacttttcattttgttgattattaatttatttattttgagatggagttttgctcttgttgcccaggctggagtgcagtggtgcaatcttggctcactgcagtctccacctcccaggttcaagtgattcttctgcctcagcttcccaagtagctgagattacaggtgcccaccaccacaaccggmtaaatttttttttgtatttttagtagagatggggttttgccatgttggccaggctggtctcaaactcctggcctaaggtgatccacccatctcagcctcccaaaatgctgggattataggcatgagccaccacgcccggcctatttttttaagtctcaagttttatttctgctctgatcttgattatttcttctaattttgggtttggtttgttcttgctttcacaattctttgagctgcatcattaagttgatttgaaatcttcctacttttttgatgtgacgtttattgctataagcttctttcttaatactgcttttggtgtatcccataggttttggtatgctgtgtttttatgttcatttgtgtgaagaaatttttaaatttccttcttaatttctttgttgacccattggtcactcaggagcatattgtttaatttccatttatttgtatgattttaaaagtttcttgttatttatttctaattttcagagcacagtgttcctttgtggtctgaaaagatacttgctgtgatttcagttttcttaaatttctcattatacttattttgtggcctcatatgtggtctgtcctagagaatgttctgggtgttgatgaaaagaatgtgtattctacacctgttggatggaatgttctgtaaatgtctgttaggtccatttggtctaaaatgcaatctaaatgtaaaatgtagtataaatccggtatttctgtgttgattttctgtctagatgatctgtccaatgctgagagtggggtattgaagtccccaactgttattgtattggtgtgtatctctccctttagatctaataatacttgctttatatagctgttctgtgttgaatgcatatatatttgcaattgttatatcctcttattgttattacataattactttctttgtctctttttaggttttttttgtgtgtgtgagacagagtctcactctgtcgcccaggctggagtgcagtggcgcaatctccgctcactgcaacctccacctcctgggttcaagcgattctcctgcctcagcctcccaagtagctgggactacaggtgtctgctgccatgcccagctaatttttgtatttttagtaaagacagggtttcaccatgttggccaggctggtctcaaactcctgaccttgtgatctgcccgcttcggcctcccaaagtgctgggattacaggcgtgagccaccgtgctcagcctctttttagtttttgacataaagtctgttttatctgatataattatagctactcttgcttgcttttggtttctatttgtgtgaaatatctttctccatcccttcactttcagtctgtatgtgtctttgctagtgaaatgagtttcttgtaggcagcatatagttaggtcaagtattttttttttttaatccattcagccagtctaccccttttaagtgagggaatttaatctatttacattcaaggttgttattgatagtgtggacttacttctgttgttttgttaattgttttctgattattttgtatgtcctttgtttcttcctctcatttatcattatggtttggtggttttctgtagagataaggtttgattcttttctttttctcctttgtgtgtctgttctacaagtggatttcatacttttgtgtattttcatgatagtaattatcatctttttacttccagatgtaggactcccttgagcatgtcttgtaagggtgtgatgacttcctcattttttttttcatgtctgggaaagacttagtttatccttcatttctgaagcacaactttgctgggtatagtattcttgactgagattctttttcttgcagcgctttgaatatatcatcccattctctactggcttgtaaagtttctgcagagaaatctgttagtttaatagagattcccttaaatgtgacttaacacttttctcttgctgttttttttttttttttttttgagacggagtctcactctgtcacccaggctggagtacagtggtgcaatctcggctcactgcaagctccgcctcctgggttcacaccattctacctcagcctcctgagtagctaggactaaggtgcctgctaccatgcctggctaatttttatgtatttttagtagagacggggtttcaccatgttagccaggatggtctcgatctcctgacctcgtgatctgcctgcctcggcctcccaaagtgctgggattacaggcgtgagccactgcacccggccttctctggctgtttttagaattctctctttgacttttgacaatttgactgtaatgtaccttggagaggccttttttttttttttttttgagacagtctcactctgtcacccaggctggagtgtagtagtgtgatctcagctcactgcaacctgcgccgcttgggttcaagcttttctcctgcctcagcttcctgagtagctgggattacaggcatgcaccaccacgctcggctaatttttttgtatttttagtagagataggatttcaccgtgttggtcaggctggtctcgaactcctgacttcaaatgatctgcccgccttggcctcccaaagtgctgggattacaggygtgagccaccgcatctggctggagaggacttttttgggttgaatctgtttggggacttttgagcttcctggatctggctgtccatctctctccccagacttgggaagttttcagctattatttcattaaataagttttttatgcctttccccttctctctttggaaatccaataatatgaatatttgtttacttaatgagatcccctaagtgttgtagaccttcttgactgttttccattctaacttttttccctctgactaatttcgaatgacttatcttcaaatatagagtcattcttctgcttgatcaagtctgctgttgtagttctctattgtattttttccttttttttttttttgagacggagtttcgctcttgttgcctaggctggaatgcaatggcactatctcggctcaccgcaacctctgactcgtgggttaaagcaattctcctgcctcagcctcccaagtagctgggattacaggcatgcgccaccacacctggctaattttgtattttttaatagggacggggtttctccatgttgcttcggctggccttgagctcccaacctcaggcgatccacccacctcacctcccaaagtgttgggattacaggtgtgagcccccacgcctggccctctattgtattttttaaactttgttcattgaattattcagctgcaagatttctgtttttttgttatgatttttatctctttgttgaatttctaattcatatcatgaactgttcttctgattttgttgaatcatctatctgtattttcttgtatctcattgcatttccttaagatcattacttttaatttattttctggcaattaattgatttccttttcattggggtctattaccaaagagttattatgttcctgtggtggagtcatatgtccttgtttttttcatgtttcttatgtctctgtgttgataccccacatctggcagaacagtcacttcttccaaactctctggagtggctttcatagagaaagactttcacatgcagttgggttttagtgtgccagttgggaagggtatggcaactctgtttctggatagatgtagtggtatgttttctgtgtagcttcttcagctgcattcaacatgagcaataactatgggtgcctcaagagtcctaggctatagaagtgtggcagtggcagtggtggtatatgttgttaatatccttggtgtcaaggagttttggagtcctcctattctcattttcctcacaatggagtgactcagccaagagaatccctcttggtgtcaggtctgactgacatggcctacaagcagctgcagaggcactgggttccaggtacagatgcgtggagtagctgtggagtcaggtttccaggcttagggtctcacaaacctattgtggcacctgggtattggggtacagatttgctctctgtggcaaggttggatgtaggttgcccacagagccaggatctgaggcacccgctagcagctcaggcccaggggactggctcataactgtgattctaatactgggggataggccatagcactggccttactctgtggaagaaggggtgctctggaggtttgggcctagggagcagggtacagctgcaattcagggatctgagccaatagggctcagtggcagctcaggtcccacggaatgaggcaccatgtagtagtgactctagactccaggatggtggggcttggctgtatcctagactctgtgaagccaagtgcaatggcagcgaataccccagcrtggcagagcacagctgtcatttkggccctgggggtcagggagcagcacagcaatgactccactccccaggaagagggtatcttagcagctcagactctaggggcaagtccagttccagggaagcagggtactggagttgtttggctagggcaaggtatctcagctcagccactgctctgtttcctgggacatggggtactgtgtcagctcagccctggaatgcgtagctgctcagcttggccagccaccaattcccctggggacaatgtgctgctttagcacaggcctagtgtgggcatgactgttctgggtgacccaggcacagtatcattggaatgcagggtgccgcttcaagttaggtgctaggatgcatgactgccctgggtggccaaggcaccatttcctgggatacagattgcttcttcaccttaggcaccagggaggcctgactgctctgagcagtctaagtactgttttcatagtggatagggtactgcttcagctgcagcccaaggggagtggggaggggtaggtggagtggctctgcctccacttggccccttggggaatcatgtaatagctgctcacagcttggcttagattgtcaagacatcaggctagagtggtttgttggtggcttagcctcaggaatgaaggggagctgtggccatctgtccccagagcaaaacacaatcccactgtagctccacttccaagatggcatagcacagtagctgcacaggccacaggggctggcgcatagtattggctccttctctggagggagcacagctgtatggactccaggcagctccttcagctgggcttagtgcctagaggactgtagggaagccagtggtgaagtctgtaggtgtccaaggtgctggtggcagtttctagaattgtcttgcttacttccttgctgtggggagaagttcctccttgttcccagctgatcctagatgggggaagggggatgggggggaggcctgatattgccatctgttctctatgtggccatcctgagtttctgtgctcatcagcattcctgtcacccttctgatacacccccacagtctccctcagttatttttgttaaaagtatagctgtttattactctacctctctttgtgagggggatgtgctttaggggctgctcggccatcttgctgacattactcccctaggctgtttttttttgttgtaactttttaaaaatgtttatttatttacttttgagacaaggtcttgctctggtgcccagactgcagtgcagggtgcagtcatggcttggtgcagtcatggcttactccagcctcaaacttctgggctcaagcaatccacccacctcagcctcccaagtagctgggactgtaggcatgcaccatccctcctggctgagatttttatactttttttttttttttggtagaaacaggttcttgctatgttgcccaggctggtcttgaacttctgggcttaagtgatcctcctgtttcatcctaccaaagtgccaggactatagatgtgagctatcatgcctggccaaagtgagctgctttaataagagtatttgaaattattccagtgtgttttaattccaaatgtattaaaataggtatgatggagtatcggtcttgcaggaagccattcagcttcagtgtgctaccttttctggcatctttctgggacaaattcgtatttgttctatgctggtgagcaagggctctttatacagagctgctgagtgtagcgacctaaatttttttgctcaaacaaggctgttttaataagaaataaattatataaagtcacgtgatccatttagtaaaatattgggctgtgaaccaggagactggtatttagtcacactgattaggtcttacccaataacctttgatcagttgcctctctacttactctatttcatgtgttgtgaaatggcatgatattacctacctctgatctagttgaaaatcttttttttttttttgtgagatggagtctcattctgtcacccaagttggagtctcactctgtcacccaagctggagtgcagtggtgcaatcttggctcactgcaacctccgcctccagggttcaagcgattctcctgccttagcctcccgagtagctgggactataggtgcatgccaccacacccagctaattttttgtatttttaatagagacagggtttcaccatgttagccaggatggtctcaatctcctgacgtggtgatcccaaccaccttggcctcccaaagtgttgggattacaggcgtgagccactgcacccagctgaaaatcttttaatgaatagaaaatctactcagaagtagcagatgaagttagtgatattttttagggtcagtaagagttgataggaaagaagaaatgaacatttctcagttactggccaggtgctaggcactgttaggtgccttatatgtatcttcaaatttaattcttgtaaagtagtcctatgaggtaggtattataaccttcctttgacagataaggaaaatgaggctcagcgaagctgatttctgtacctaaggtcacacagctaataagaggcacggatctgaactttggtcagtctgatggcaaaccctgggttctttctgctgtgttatgttgctacacagagaattaatctgattgttgtttttgttgctttaaagagaaaataaccttacagagactaaggagtaaagataagtcaaaaatgaaaactttattgtatagtttaggaggcagtaacagaaagcagcgtaagtggacttgcagaagcaggggtactggagtttatgttgctaatggatggtgactggtgtgagagcctcttagtgaagtgcgtggtttcctttgtctctattcattgctacctctggccactgacctatcacctcttctctctagggtaaagcccacagcttgaagccaagcataaaggagaagctggcaggcagccccattcgtacttctgaagatgtgagccagcgagtctatctctatgagggactcctaggtgagaaacacactgggaaggcyctttgcactggagaaagctgactcagccaggggagagggtcacactgaacaagtagctggttgtctttctgctgatcttaatgctaacattagatagcagttttatacctgaagcaagcgacttactgggtccagaacaagcagtgggtgaaaactggacaagattgggttttggtgttaatcaacagcctttgcctttctgtcttcctttctttcctttcttgctaccatggtccttcctgctctcaaattggcaggaagggacaaaggatccatgtgggaccagttagaggatgcagctatggagaccttttctataagtaaccacatttatttgtgtgctgtgttcatccctcctccttgggagggactgggccttacttggaggcatctggggctggtggcaggcatgttagatctggggtagaaagattgtgtttcctttgccctggaatttgtaattattcccttttatctggattttactctttatttttgtttggcagctatattcttaaatgttaaataggccccctaagaaacctttattctatgcaggcaaagagcgttctactttatgggaccaaatgcaattctgggaagatgccttcttagatgctgtgatgttggagagagaagggatgggtatggaccagggtccccaggaaatgatcgacaggtatggggcttaggaaaccattgggaatcagcaaactcrgcctcctcccagttagttctgtggtctcccacttgagggctgacttgtgcttggtcttctccttaggtacctgtcccttggagaacatgaccggaagcgcctggaagatgatgaagatcgcttgytggccacacttctgcacaacctcrtctcctacatgctgctgatgaaggtaatgtcaattttgctgtgtccagctccgctgatcctagaggggcaaggcttgttcctgtcgcctaaatttcggggtagctgggaagctatcaaggtatcttaacttagggctatcttcttgattgaaagtctgaggcctctctgccagcttacaaatgttccatttatctgaagctgccagccagttttactaaggagtgttgtaggaagaactgatgattctctttttttttttttttttttttgagacggagtcttgctctgtcacccaggcaggagtgcagtggcgcaatctcagctcactgcaacctctgcctccccagttcaagtgattcttgtgcctcagcctcccaagtagctgcgattacaggcgcacaccaccatacccagctagtttttgtatttttagtagagacagggtttcaccatgttggccaggctggtctcaaactcctgacctcaagtggtccacccaccttggcctcccaaagcgctgggattacaggcgtgagccagtgcgcccgaccaagaactgatgattccatagtatttatttatttatttattttcattttctttttttttgagacagagtcacactctgtcacccaggctggagtacagtggcacgatcttggctcaccacatcctctgcctcccgggttcaagcaattctcctgcctcagcctcccaagtagctgggattacaggcatctaccaccatgcctggctaatttttctatttttagtagagacggggtttcacaatgttggccaggctggtctctcgtacttctgacctcaagtgatcctcctgcctcagcctcccaaagtgctgggattacaggcaggagccaccacacccagccattatttatttattttgagatttatgtggtctctctttactaagtagttttagggtgccaatagagcttcccacaaaatacaatgaattaatttttttttttacaatagtagattttaaaaccttagaaaggatgctcaggaccaggcgcggtggctcatgcctgtaatccaagcactttgggagaacagggcgggcagatcacctgaggtcaggagttcgagaccagccttgaccaatatggtgaaatcctgtctctactaaaaatacaaaagttagctgggcatggtggctcatgcctctaatcccagctacttgggaggctgagacaggagaattgcttgaacctgagagaaggaggttgcagtgagccgagattccaccattgtactccagcctgggcaacaagagcgaaaatccatctcaaaaaaaaaaaaaaaagaaatgatgctcagaatttgtttttcagcacagccctatatcttacagaattttctatagttataaaaagagccactcattaacaaagtaatagtagattttaacttgatttggttgtacttggttttatagctgtggaagaagtatgttaccaagtagaagagttctgctctgaaagggaaacataaatctggagttgatgggtagaagagaattgtttggagaacgagccactgggtttctcctccttctgttctccccaacctccctaagtgtgaagggatcagttgatcaaatgcagagaatgcccccagcccctcttggtgtgcttcatttcctggtgtaagttgcactgtactctgtggaatttggagggtaccagttgactctggctgagaaaggatgatgatccctaaccttcagagatgtcttggctacccagtctggtgttgccactctaagtcattgtttctgaattacactatgaagagccttgggtgtttttagagcccttgtaggggtgaatgttgtggtattgagtggggatagggagaaagtgtcccctggaaccagaaccgctctaagagccacttttctgcagaagctaactagagacagagccaggacttttcttcccctcatggtggcagaatacacagttgaaagttttctcccatgttcagtgatgtggtctttcagaattccacttctctcagatggtgggaagcccacttgtacattctcttttctctacctcagtcgggaggagagcagatcccttgttaagagtcatgtgttggcttttcaggtaaataagaatgacatccgcaagaaggtgaggcgcctaatgggaaagtcgcacattgggcttgtgtacagccagcaaatcaatgaggtgcttgatcagctggcgaacctggtaagcacgtctggccaccccttaggcttccccatgggtcatttcttggtttgtgtcacttgcagtccagttcaccccgtttttgaaaatggagcagttgtctttgactgtaaatgaggcattagtccctgtgttctgtgatgggattctctgtataaaaccatcgtagtgcatcagttttgatgtgtggtctgtgaactgctgagggttcagaaggtgaaaacgatttcaaatgattctaaaatgttatttgctgttttcacggggttacatttgcactgatggtaccaamgcagtgatgggtaaaactgctggcactgtaacccaagtgaagacaatggccccaaactatgccagcagccattgcattccttgccttcatatactctcagtttttcgtttttgttttgtttgtttgttttttgagactgactctcactctgtcgcccaggctggagtgcagtagcgcaatcttggctcactgcaacctccacctcctgggttcaagcgattctcatgcctcagcctcccaagtagctgggattacaggcatgtgcccgcccacccagctaatttttgtatatacatatatattttttgagacagagtttcactctcttgttgcccagactggagtgcaatggcgcaattttggctcactgcaacctctgcctcccgagttcaagcagttttcctgcttcagcctcccgagtagctgaagctcctgaggttacaggcatgcaccaccacgcccagctaatttttgtattttcagtagagatgggcattccccatgttggccaggctgatcttgaactcctgacctcaagtgatctgcctgccttagctcccaaagttctgggattacgggtgtgaaccaccgcacctggcttacactcttagttttttaaaaatgccagttgtgcttgtaaatgtccttgaagaagcagtgaagactgttactcttattagattgattaattataaatgtttttaatattctttgtgacaaaatgggaagtacacataaagcatctctgttgcaaacccagtatgatggttgttttgaagaaaagcaatttgcagccttgatttgttcaccttgagttgcaagtgaacttaatcgctttgttcattgaacatcatttttactggaaaggacaattaataaaccatggttattcagagtacccaactggcagacattttccttcagttaatcaagtgagcctgttgtttcagggaaaacaactgacagtatttgttgccaatgataagattcagcttttaagtgaaaataagaattttggcagagttttgaacttgaagcttcccaatatttaaagacttttctaatgagattggtggtgatattaatgaatgtgattttttaaacattgatttaatattacaaaatatgtcaacatttggaagagctgtgtaactcagtgaaacactattttctttctttttttttttttggagacggagtctcgctctgtggcccaggctggagtgcagtggcaggatgctggctcactgctacctccgcctcctgggctcctgggttcaagcaattctcctgcctcagcctcctgagcagctgggagtacaggcgtatgctgccacacctggctagtttttttttttttttgtattttaatagagacggggtttcaccatcttgcccaggctgtggtcttgaactcctgagtttagtcaatccgcccaccttggccttccaaagttctaggattacaggcacccagccaacagtattttctaaataccaatgtatgatgttgtaaattcaagtatggataaaagatctactcaaaatgcaaggcagagatatggatcttaatttttaaataacattttttttcagtctggggaacatagaccccatttctttttgtttgtttgtttgtttttgagacggagtctcactctgtcacccgggctggagtgcagcggcgcgatctcggctcactacaacctccgcctcccaggttcaagctattctcctgcctcagcctcatgagtagctgggattacaggtgcccgccacaacgcccggctaatttttatgtttttagtagagatggggtttcaccacgctggtcaggctggtctccaactcctgaccttttgatccgcccacctcggcctcccaaagtgctgggattacaggtgtgagccaccgcgcccagccaagggagaccccatttctacaaaaaataaaaaaattagctaggcatggtggcatgcacctgtagtcccagctacttgggaggctgaggtgggaggatcacttgagctcaggaggttgaggctgccgtgagcaccactgcactccagcctgggtgacagaatgagaccctgtctcaaaaaaaaaaaaaaagtgtatggagaatagggtctcactttgttgcccaggctggtctccaactcctgcctgggctcaaacggtactcctgacttggcctcccaaagtgttgggattataggaatgagccaccatgtctggcctaaatggattttaatgtaacaatgtaaaatgttcattgatgtgctttcagattccacactgcaactaactttcaaaagctgcttttgctgggtgttgtggtttatgcctgtaattccaggtacttgggaggctgaggcaggagtgtcacttaagcccaggagttcagagctgtggtgggctatggtcatgccactgcactccagcctggatgacagagcgaaaccttgtctctaaaaaaaaagaagcttctgcttcccaagttctggtgtagtgttaaagaagaatacgtctatttatctgaaaaggctatgaaaatcctcttccattttccaaatacgtatctctgaggtcaagtttttttcatatacctcaaccaaagcaacatactgcaacagactcaatgcagaggcagataggagaatgcaactatttgattctaagccaaacattaaagagatttgcaaaaatgtgaaacagtgccttttttttgaaaatatagttattttattaaaaatstttatattactatgtaatgggttatattaatcattaattgtttttataattaatcatttgagaaatttctgtttaaatttctagtatgtaaatatctataaatataactcacataaacaaaagctctttggaatcttcaataaattttaagagatatagggcctctgagaccaaaacatctgaaaccacttccctggtgaccagtggccagcagatgagactgtgctgaggaagccgatatgaatttgattgctggatggggaattcttggcccagagccctctgagagggatgtatgactgtccctaaaaaatctctctttcatcagaatggacgcgatctctctatctggtccagtggcagccggcacatgaagaagcagacatttgtggtacatgcagggacagatacaaacggagatatctttttcatggaggtaggtgctggttcatgctgggggcccaaagggctattgagagtcacarggaactcataggaccgatgccaggatatttttctcatttatctcattcatcttcatgatctatttatcattaaattatcagattggtttttttgttttttgcgtgtgtgtttttttgagatagtgtctcgctctgtcacccaggctggagtgtagtggcttgatctcggctcactgcaacctccgcctcccgggttcaagcagttctcctgccacagcctcccaagtagctgggattacaggcgccagccaccaagcccaggtgatttttctatttttaatagagatggggtttgatcatgttggccaggctggtctcaaactcctgacctcaagtaatccacccaccttggccttccaaaatgctggtattataggcatgagccaccgcacccggccaaattatcagattgttattcaaataattaaattttatatagtagatgatacccatttctttttttttttttttttgagacagagtatcgctctgtcacccaggctggagtgcagtggtgtgatcttggctcactgcagcctccacctcccaggttcaagcaattctcctgcctcagcttcctgagtagctaggattacaggcatgcgccaccatgcccggccaattttttgtattttagtagaggtggggtttcaccatgttcgttggccaggctggtcttgaactcctgacctcaagtgatccacctgcctcgacctcccaaagtgctgggattacaggtgtgagccactgcgcccggccccatttcttttatacacgtgcgcgcgcacacacacgcgcacacacatatacataaagatatctatatatagatgatatagtcacattgttcataaatcagaataacagaaaatagtacacattgggaggtcttgcactcattcttgtccccttccactgaatttcccactcccctcaccccttcatcctatagacaaccacttttattggtttcctttgtaaattccagtggattttttttttctttttctttttytttttttttttttttgagacggagtctcactctgtcgcccaggctggagtgcaatggcttgatctcagctcactgcaacctccacctcctgggttcaagcgattctcctgcctcaggctcccaagtagctgggattacaggcgcccaccaccgcacccagctaattttttgtatttttagtagggatggggtttcaccatgttggtcaggctggtctccaactcctgacctcactgatccacccgcctcggcctcccaaagtgctgagatcataggcgtgagccggtgcacccggccttccagtggacttttatgcaaacaataaaatatgaacacaaattcttattttcctcctttcttttttttctttgagacagagtgttgctcttttgctcaggctggagtgcagtggtccaaactcagctcactgcaacctctgccycttgggttcaagtgattctcctgcctcagctgcctgagtagctgggattacagtcgcccaccaccatgcccagataatttttctatttttagtagagacggggcttcaccatattggccaggctggtctcaaactcctgacctcaagtgatctgcccaccttagcctcacaaagtgctgggattataggcgtgagccaccccgcctggcctatttttctcctttctttcagaaagatagcacatcttatccattgctttatcccttgcttttttcatttaacattgtcctggtcctcttctgtatcagtaccaagaaagctttcccattggttttatggctacatgtattccactgtgtgactgtgccttaatttatttaaccagtcagtacatatggatccttgggttgcttccaaatttgctgttactgatagtcatactgtgaatgatgctgtgcctgcttcatttcatacatgtgcaagtgtgtctaaggattcccagaaatgagattgctgggtcagagggacaatgcatttgtaattttggttgatataattcttaagtgtctcataacacgtaataccccctttgccattaattttgttgaagaaattggatcgtttgccctgtggagtctcctacattctagattttttgctgattgtgtctcctttgtattagcgtgtttcctgtcacatatttctcatagactggtagttcagtttagaggtttgatcactttcagattcactcttttgggaagaatacttaatgagtggtgctatacgcttcctrttgcctcatatggttgtccctctcttacacatcagtgggctcagatgtgggcaacctgatctgcccaccagaaagttcctcatttgtcttctgattttgcctatggtattttttgacacacataaattttttatttgtatataacttttttttttttttgagacagagtctctctctatcgcccaggctggatgcagtggcatgatctcggctcactgcaacctatacctcccgggttcaagcagttctcctgcctcagcctcccaagtagctgggtttacaggtgcctgccaccacacccggctaatttttgtgtttttagtagagatggggttttaccatgttggccagggtggtctcgcactcctgacctcaagtgatccacccacctcggcctcccaaagtgctgggattacaggtgtgagccatcacgcctggctacttttatataattaaattaatcaatagtttcttttacggcttctggattttgaggcatggttagaaaaagccttactctccaggattataaaggaaattggccgtgttttcttcatttctgtgtttttaattctgaaacagacctaagtaattttaaggaccaaatacaactcctatatataaagtagtaaaattttgcctatgttatctgttcccctgtggtttagctgaatttgaatatcacattcacagtttttttgaacaggtggtctaccaaacgcaagaagggcttaccctgaagcagaaacatacatgtcagtgtagccaagaaggagtcattttcatgtcaccctttaaagtgttagaatttggctagttgcctctcagagcctagggctgacttaggacatctgcaccacagcagaagtggcacatgactcttgcccttttcttttccttttaaaaaaaatatctccagcagattccttgaactactcttactctcaccaccgtacaaagggagcctcatgctaagtctctggagtgtgggactggacccattacccaaatagatgcctcttcctcgaagtggtgccatgccagggaagagtgcaccatggtcactgtgccatcacctggctcctgtgaggctatttgatttagcctttctcagagcatagcctgctttctgcatgatcaactggacagcagtttgggaattttttttttttttttttttttttttttttttttttgagacagagtctcactctgttgcccaggctgaagtgcagtggtacaatcttggttcactgcaacctccacttcccaggttcaagcgattctcctgcctcagcctcctgagtagctgggactacaggcacatgccatcatgtctggctaatttttgtatttgtagtagagacggggtttcaccattttggccaagctggtctcgaactcctgacctcaagtgatctgcccacctcagcctcccaaagtgctgggattacaggtgtgagctgccrcacctggccaaggaaaatatatatatatatataattttttttttttttttggaggtggagtcttgctctgtcacccaggctggagtgcagtggcacaatcttggctcactgcaacatccacccaccgacttcaagagattctcctacctcagactcccgagtagctgggactacaggcacgcatcaccacgcttggctaatttttggtatttttagcagagatggggttttgccatgttggccaggatggtcttgaactcctgaccttaagtgatccgtctgccttggcctcccaaaatgctaggattacaggtgtgagccaccatacccagccaaagatttttaaaaattgtctttgttgccctttttttagttacagaagtaaaacagtatatgctgtaaatgtttcaaaccgtgccaaagttaaaaaataattaaaagttttactcactgcctttcaatcctttgtcccagaggtaaccagtaatgaagagttttatgtgactcctttcagattattgaaaatgcatatttgtgcaaatataatttatttatatggaattttgtttttgcacttacgaaagtggtatcaaattacaaatattgggctgggcatggtggctcacatgagcctgtaatcccagcacattgggaggccgaggcaggtggataacttgaggtcaggagttccagacaagcctagccaacgtggtgacaccctgtttctactaaaaatacaaaaattagccgggcgtgttgggcaggcgcctgcaatcccagctacatgggaggctgaggcaggagaatcgcttgaacccggaggcggaggttgcagtgagccgagatcatgccactgctctccagcctgggtgacaaagcgagactccatcgcaaaaaaaaaaaaaaaaaaaaaattacaaatattgttaaataatttgcttttttcacttaatgatatacctttccgtgtctttttttttttttctttaatggatgcttagccattagatgtcgtatggtgtaccataattggtttaactagtgcctctcactattttttaaaaaaatattactcatgcygggtgtggtggctcacgcctgtaatcccagcactttgggaggccaaggtgggtggatcacgaggtcaagagttcaagatcagcctggccaagatggtgaaaccctgcctctactaaaaatacaaaaaattagccaggcgaggtggtgggtgcttgtaatcccagttacttgggaggctgaggcagagaattgtttgaacctgggaggcggaggttgcagtgagccgagattgcaccacttcactccagcctgggcgacagagcaagactccgtctcaaaaaaaaaatttaaaaaaatgaaatatatatttatatattactcattaggccaagcatgttggctcacgcctgtaatcccagtactttgggaggctgaggcaggaggattgcttgagcccagagtttgagaccagcctgggcaacatagggagaccctgtctctataaaaaatttaaaaattagtcatacatgtggtgatgtatgcctgtggtaccagctactggggaggctgaggtgggaggttcgcttgagcccaggaggtcaaaaccagcctgggcaacatagggaaaccccgtctccacaaaaaattttaaaataagctaggcatgctagtgcatgcctatggtcctagctactggggaggctaagttgggaggatccttgagcctgggaggtcaaggcttcagtgagctctgattacaccacttcagtccatcctgggtgacagagcaaaaccctgtctcaaaaaataataataataataataattgctcattgaatatccttgaacatatatttttgcaccctcacatgagaatttctataggatatagtcctagacatgaaaatttcaagtcaagcttatatacgtttaaaatttcggtagattttgccaaattgccatcccaaaaactataccagtttacacctccaacagccacttagacgactataacagtatattacaagcatttctctagactagaatgctctagcttagaaatcatgtgttctcctaaatgtgttctgcctgcctttacatgatgttcttaaaggattatgaaaggtggagtggtattgtccattttccccctggagataaccacagagtcagactgggcctagaactcaagtttcccattcctactctgccactttgactgattcttcaaaggctttagaactccagtaaagtcttatacagtagcttaaacctgatagtcttgtgtgttccttactcactcacctaatatttgtggagcacgtattatatgctaggtactttgttgggtgttgggattatagcagtgaataagacagacgtgatttctattgcccttagcattgacaagctattggggaaatcagataattaaagagtattataaaatatggtgagcattatgaaagaagctcagggggggcagaataaataccagagggcctaggagctgtggacaactcctttgagaagttgacctttgagcttagacttgaagaaagagtaagagttaatggttggggagtggaagagcagtcagggatatttgagctagaaccaatgggactcagtgatggagtgtagttagttagagggaagaggaaggagtcgggcatcaattcttcatttcaggctggggcagctgggtggatggtggtgccatttcctcaaatagcagacttaaaaggaggatctgcccaggaggagatgttgagttcagatttggacacaatgagtttgaggtgctacatgtgaagcatccagacactgagaagctcaggagctcaggaagagaggtctaagatggagaaaggtaagaaccatcaacatggtaataatcattagtatcatagttctgatatctagtagctaattagggtactttctgtgtgcctggctttgtgtgcaccttaaatactttatgcacattaactcatttagtcttcatagtaactgtaggaagttattactgttactatccccatcttacctgtgaggaattgtggacacagatgaacttgctcagggtggcacagctcagtaatggcagagctggaatctaaactcaggctgactttagacctgtgcccttcaccattgtgctgtaatgtctcccgtaacatttgaagccttaagaacggataactggctgcgcatggtggctcacgtctgtaatcccagcactttgggaggccgaggcgggcggatcatgaagtcaggagatcragactatccttgctaacacggtgaaaccccgtctctacttaaaaaaatatataaaaaattagccgggcatggtggtgggtgcctgtagtcccagctactcgagaggctgaggcaggagaatggcgtgaacctgggaggcggagcttgcagtgagacgggattgcgccactgcactccagcctgggcgacagagcgagatccgtctcaaaaagaagaacagataacttcacctgaaagagaatgttgaacaagaaggtgtcaaagatatttgctttttaatttatatcatcctgtattgtatcatttttatgtaataagcattgttcatgtgtcacttgtgtaattaatttttaaaaatatttttatagaaaaagggtagacccaggattagaaagtgcatcagctccatttttctccttggttaagtctgtcatgatctcctacctttgtgtttgtcaacaaagatgattcctgagcttgtaagatggaggcatgagatctcctccaaatactttaagtccgtagagcacataagaggtaataaataactgggccgggcgcggtggctcacgcctgtaatcccagcactttgggaggccaagacgggtgtatcacttgaggtcaggagttcgagaccagcctggccaacatggtgaaaccctgtctctactaaaaatacaaaaattagctgagcatggtgatgtgtgcctgtaatctcagctactcgggaggctgaggcaggagaatcattttaacccacaaggcagaggttgcagtgagtcgagattgcaccactgcactccagcctgggcaacagagtgggactccatctcaaaaaaaaaaaaaaaaaattatagccaatgtgatggtgtgcacctgtagtccctgctactttgggggctgaggcaggaagaacctggctggtcgaggctgcagtgagctgagatggcgccactgcagtcaagcctggggtacaaagtgagaccctgtctcaaaaaaaaaaaaaagaggtaataaataactgattgatttgtgcctcctcccttatacatcggttccttctaatgactccatctcttccaacaatccttgtagcaggcagcatgtcagtagttctgttttgtgtcttcacctagggaaaccaygagcgtaaggcagaaaacctgaccatggggatgccccaggaccacctttccctgtaggaaacagtctagggagaggctgtcagagacaggaaccactgagcygctttgtgcacttctccaggtgtgcgatgactgtgtggtgttgcgtagtaacatcggaacagtgtatgagcgctggtggtacgagaagctcatcaacatgacctactgtcccaagacgaaggtgttgtgcttgtggcgtagaaatggctctgagacccagctcaacaagttctatactaaaaaggtaygcaggatctgtgtttgggttggggctagtaggcattgaagaccaaatagtgaatttctctttgggaagttaaaattccaaaacacacatctggagccacacttctgtctccagctgttgggtggagtacctaaagctgtctctgtcaagccaactaggcctaatagtagtcacaatcggtattaaccaaccatatctagcattcctacacatctgtacccatgccttctttaaagccatactattcatatgctccggatctatcattcataacctcaacaatgaataagacatccgaaaaataggaggactacttaaaattttacccctcacttcaacctccagccttcagtggccattatagagcagtgggtggggaaccctggacagccctcatgatgggaccactctccccctgtgccacagtgtcgggagcygtactactgtgtgaaggacagcatggagcgcgctgccgcccgacagcaaagcatcaaacccggtgaggagagtttttcctgagagtgtcytccctgtttctaccagtccttctgagtgtcaggggcctggcagggaagtcaggggtgggattccccacctcaccagtgagctgatagccccctccctcaccacaggacctgaattgggtggcgagttccctgtgcaggacctgaagactggtgagggtggcctgctgcaggtgaccctggaagggatcaacctcaaattcatgcacaatcaggtaggtgcgagcggcarcacgaggctccctgtcgttccatctgtaagaaggaccaatgtccaagcccccagtacttccccagcaagcatgagagagggccctctggagctagagggagaactggagcagctggacccaggaaagaaaccccaggggagggcacagtgacgttggcgaccacctggcgctgtgaaggtgcaccagggagcccgtgggggaggctgggcaggagcgaggccaggtggccacgctgccccatccgttggactccacacagtgtgagtgggagcgtctcacttggcccttcccctgcagtgtctctgccttcctctattcccaggatatgcttctgcttggtggttttgctttgagagtctagactggccgatctccttgtgtctttctggtgtgcgtgcagcttgcgtgtgcgtgcgtgcgtgcctgcgtgcctgtgtgtaagtagcttgtatctgtcctctctggagtgtgtttatttgcctttttcttctgcggattcttcttcctgttcttttccttcctctgagtgttcccactctgtcccctgctccacaggccccattccctttcttttgaytggggagcacttgtggatacatctttccctcattgtaattccaccataggagctgacttttttttttctctcttggtcttttaacacagtgttacctttttctctcagtggacattccttaagctaattcctttctgaggccagcgcatcatcccaggtccgttcacagctctgactcctcacacaagtgccttccctcctctttccctgatgtccrggttcctctccctgaggctctgagccagacccaaatgtgtgaagccccacagaccctggccaggccgcagaccctcaggggaggtggatgcctgactgacgtggctgtctccctccctccgctagccgttgtagctctctttcaggaacgtagctgggcagctttggtttaacaggaaatggctgcgcaggctgccagcagccccttagtatattttcaatytaggacttagggcagtagccaaccccaaagaccttaggaccatcccagagaggggtctacctaagtgcttttctggaccacaaaggtgtcagtacttcttggggagcagacttctgaccacattttagcgccgtggcctctgaagatgagatcttgctgagcaacgcccaggtgctctgccctgttcctcgtcctgcccttggcatagccccactgggcagccatccaagccagtctgtggttgaaggcttggcccctagaagatagactgcagagaaggggaggaaagcccgggttctcaatctcacctcacagttagtaatgagatagcgacctgccccctattctgccacacagtgttcagttggagtggaggaggcagcagacctcctggtggagctgtgcagtctggggtaaatgggaaaagcacaggcttcggtgtgaggacatgcttggatttgaagcccagcttccacgttcatgggcaaagaaactttctgatccatagtttcctcatgtagaaaatgggggtaatactatttactgtgtcacgtagtaggtgcagagattagaaatcgtatttgtaaaaccccaagtaggtgctcagcaagtggtagctgatattattatcaccacatacctcttgggagatcctggatcctgtttcaaggaggataccaacacctcccaccctgaggacagtctgaggggagctttgcgcccgtgccagccctctgcgccggaggaggatgcatggaagggtagagacctaatgggctgagtggggacccctggggcactgtgtcttacaagcactgccctgggcagagggtacgggcgggcagcccaggccagcagcagggccttcgggttgggtttgaccattcaaactaacgccttcatttctctcccatgctttctcctccggccaggagcggaaggtacatgccctttctgctatcttcgcttcttagcgcttttgagttgtgtgcgtgtggattcttctgtcctctctttgggaaatagactttctttgtgtgggtggggctgtagctgggagagtgtgctgtgtggggcaggggtggagcctgtgggccttaccccggcctccctccctctcttgcaggttttcatagagctgaatcacattaaaaagtgcaatacagttcgaggcgtctttgtcctggaggaatttggtaattacactattttgctcttaggtctggactcacatggcagtaactcaaacctyggagctccagaggagggtctaggggcagggagaagaagaacctctgtagagaagtcaggaggagcaggagtgacaaggaagaaaagggacccctgagatgagagccgggatgtggaagggaaagatagataatggatcgcagaagagcaaatggggcctcaggtgggtttcgagtttagaggtggtcctgaagcagctcagtgaagtagcaccacctccccgtgctgggccagccagtggtcagaaagtttgggacacagcagactggcgacccccaagctccactaygtccatgtcacctgctgcaatctctctagcagcccagtgcgctagccagcctccctggcgccgctctggtctccacctggcctctgtgccagacaaaggggcaccgggcgtcgcaggcagactcacttgagggacagaggagtctagcgggacagctgtagccggaagctgggagccagcgctagggagtggtgtagtgggttctcaccctggggctttgagttcctgctgtgtttgtgcttcattcttttgtgcccctcatcgctgctatgaaaaccttcgttctccagcaggtaaagtgacctcggctcgtgctgcctctccccaggtctctgccttgggccctgccctgggtgggtagctcccatcgaaccagctcctcacactgccagctcgtctcttcctttctcccctaccctctttcttcctaccttgcctcccccttctcaccggctcactggactttcctccccgtgtgttcccttctctcttctgtcagagagatacttgggggaatcttccaactcgggagaatggcctggggcttcttgctctacctttgatgagtttattccctgctgaccctgggttcccccaaattctacctcccagggtcagaagaaggtacggccaattctcctcctgccttttctggcccccagggagatgccaggcccctctgctcccagtctcaaggggccatgatggtggctgagcctggggggcctactccttcctctggccaagcagaacccctgcatggctggagcggggggactctcactcttgccttctgggctgtggacatgtgtgtattttgcctgatgctccctgtcacctccctccctgggtgctgtactcgcctgtcttctgctgggtgtgttgctccagagccctcagacgctctccctcacacaggcaggtctgggcttctcctgccactcagggaaggacactgccacatcctgtgggtttatatcatgttacctcttcatccagcctcaagaccctctgtgtagggggctgggaataacgggaactgtgtttaacatgacccaattttcaggctggtgacgagttcacgggtgtctcagcaaagttggacacaagctagagagagctctctcctcccagccaaaacctrggaattccccactgcagctcctcaggggccctggacagtagctgtgaccaggctggtgaaaggcccgtccctcccatccagggctttcaaagaagtgggtagaatcacggccatcaagtaaamgccactgcggatgacagaggcctagctgaggaggctagggccatgtcctcccagctggcagagtctggacagagcctctggtggcctctgccctgtcatagcctaagctgctgyagccactgtgagaggccacagaggggaaggggaccctgacgccgggcgctgccgcctgggggagcatggcacgattgctcttagtgttgaactttctgttttgtctcttgcccgtccggttttagttcctgaaattaaagaagtggtgagccacaagtacaagacaccaatggtgagtgtgccgctcaaccctgatgggccayrgtgcgcagggctccctgggggaccttcggacaggaggaggggagggccctctgagcrcacaggggtgagtggggacctcgttttgttgccaaaggttcaactcaggctgaaacaggtcttgagccctgagagacagacacacacacacggatcccctctcccatggggacagcttccttgcttggagctcacgtttagcccagaggcccatgcccagtgttagggcaggagttgcccattggcagatccttcacatatggagatgsaggagtctcagtatcgtgatccgcctggttttctctyctctaggcccacgaaatctgctactccgtattatgtctcttctcgtacgtggctgcagttcatagcagtgaggaagatctcagaaccccgccccggcctgtctctagctgatggagaggggctacgcagctgccccagcccagggcacgcccctggccccttgctgttcccaagtgcacgatgctgctgtgactgaggagtggatgatgctcgtgtgtcctctgcaagccccctgctgtggcttggttggttaccggttatgtgtccctctgagtgtgtcttgagcgtgtccaccttctccctctccactcccagaagaccaaactgccttcccctcagggctcaagaatgtgtacagtctgtggggccggtgtgaacccactattttgtgtccttgagacatttgtgttgtggttccttgtccttgtccctggcgttataactgtccactgcaagagtctggctctcccttctctgtgacccggcatgactgggcgcctggagcagtttcactctgtgaggagtgagggaaccctggggctcaccctctcagaggaagggcacagagaggaagggaagaattggggggcagccggagtgagtggcagcctccctgcttccttctgcattcccaagccggcagctactgcccagggcccgcagtgttggctgctgcctgccacagcctctgtgactgcagtggagcggcgaattccctgtggcctgccaygcyttcggcatcagaggatggagtggtcgaggctagtggagtcccagggaccgctggctgctctgcctgagcatcagggagggggcaggaaagaccaagctgggtttgcacatctgtctgcaggctgtctctccaggcacggggtgtcaggagggagagacagcctgggtatgggcaagaaatgactgtaaatatttcagccccmcattatttatagaaaatgtacagttgtgtgaatgtgaaataaatgtcctcaactcccttcaggctccctggctgccttgtgttaaatgacacctcctcttggctcaggcctgaggaaagctatccctggactctaaaaagtcacctcaggctggaaggaaggaaggagatgaggtcatccatgtccaagctttggcacacggaggccccagctcccctgttctgggctcctagagcaaggctgcgggaggagctttccttcctgggcacctgagggccctgcagagagctgggctgccatgaatgaacaggctgctagagggagcagccagactgggcgtcctcacctgaactgagattaagtgaaagaaagccaaggccctggccctctccgttcccttacaggtgggtatggtcgagagaggtgtggtgattcagccagggcctcccacagggccccggactcctggccaggagtgtcttccactgcatagaactcccagaagctcccctaggagctgccttcatggaattctgtcctggaaaaacctggctgcactctcagggaatttgagacctgctggcttcccgcgcccaaaaggaaacagatgctyggatttaggctccccatgggggaagtgagagcagagtggggccctggccctgacacctttctggtgcccagcgtcctggactggattgggttgctgtctcccaccggggatatgggtctgaacccgctgctggcttattgctggctgggactccaaagccacctagtgcagctccaccccagcacaatcacaacactgagattctgcctcaccccacctccaggcggttgtgaccacggcccctggcacaaggatcacgctgagcacctgggaccagttaaatgcactttccgctgtcacagctcagtttcatcatctgaagagtgaatgctgtaggggaagacaggttccttctagcgttaatgttttatgaactcagaaaccactctgggcctggtttaatcatcgggaaaacaaaacaaaaaacagtatctgctctcactttgctgtgaagatcaatgtccctgggcttttttctttttttttttttgagacatggtctcactccatcacccaggctgaagtgcagtggcatgatctcggcccacctcaaactctacctcctgggttcaggtgattctcctgcctcagccttccaaatagctgggattataggcgcgccaccttgcccagctaatttttgtatttttagtagagacggggtttcaccatgttggccaggctggtcttgatctcctgacctcaggtgatcggcccgcctccgcctcccaaagtgctgggataacaggcatgagccaccgcacctggccatcccctgtgcatttttatgaaaacaggcacaccgaaattgagaagagtgagttctctgtgactgcacttatcttttattgcccaataaacattgggaagacatagcaggccagaaaggcctgtccccagacattgtttcttgaggccaccctccttttaccccaaagatccaggggcttccttcaggagccctgtggaccagtctgtgcaacacccactcaggactgcccgacaactgccctgctgatcccccatcgcagcacaggagacacacttgtcacacatacatccaacagtagggaggggtttccccaacttccctccaggctcctggcacggggctggcatccggttgtacctgcaacacaggttatcttacgagtgaatggagggcccctacagcctcccatttactgatggctgccccaggaccaagggccagggctcagccactgacttgtgccctgggtgtcgggtggtacatacctggccatccccaggagccagcctggtcactgaggcactgcagaagaggaggccatgtcactgtgtcctcccagccttctggaagctattgcccatctgggcgtggcagggtccgtgcccttgcagccagggcaggtgcttggccgaggacaacggagcaaagcccagggtccccactgccgcccgctcttcccatctcccaggccctggccccgagggctcctcacctcgcacctccaggcggcactcacaccgtgcctcgccctgtaagttggtggccctgcagacatagatgcccccgtcaaaggggcagggctttctaatctccagagtcaacactccctrcttgctgaacatgcggaagcgggcgtcttctcccaggtccaggccattcttgaaccaggaaatcttgggctataaataaggtaaagagagggagggaagccatccaggctgagaggggacctggcagggacccagggagacacatctgtgtttctactcggggggtcccacgagagtccctgactatgcccaaggctggaaacaaacatggaaccaagagtgagtaccatggccctgcccagggggaggaacccggtccatacaccccaaggtggagagaaagcaggggagacaggctggggagaggactgctcaacgtcggggcctgtgagccctgcctcctggtcggcctggaccagcgcctaaagttccctaccttggggctaccccggacagcacagcagagcatagcagtgtagcccgcgatgaccgagcggttcaccaggggctgggtgaagcttggggcctcggagaagtccagggccttatagttgggtggctcataggtgatgcctgttggtgacaggacttggtaccgagagggccacacaaagctaggcccctctccctgttcccacagcctccctgccccagcccctggttggaagaatgagggtacagcacctggtctggggataaagacgggctccttggtggtggccgctctgtcactaaagccaaccatattctggctgaagacgcggaagtagtagccattgccaatgatgagctctggcaccacgcagtgggtgcggcggtaatgctccaagayggtgaaccactcctgggggcagggagggaggggaggcatctctgggccaggcccttcctgatgccgagagcctctcctgggtgcccttggcatctccacccctactatggagggattcagatcagcagagggagggtgaggggtccacggtgaggacagtgaagggtagctgcggcctgggtctgccgggcctaggcagggtgcacgtggggaccccagaccctgggctcaccatggtcttcttgtcggctttctgcactgtgtacccccagagytmcgtgttgccgacatcctggggtggcttccactccagagccacattaagaccccaggcgtcagtcacccggagatcctggggaggacttggcttgtctgcgggagacagacccagttgggtcaccacgcctcctgacagtgagcagggggtcactggctccagggaccaccccacccctgccaaccagggccaggcctgctggggcagtggactggaaaatgtgagctgtgggttgggtcccctggccccacccttggccccagcagcccagcccagggaagggaaacaagggggctcaaggaggccttggccacgcaccaacaacctrcagcaccagcgtggccttgtcctccatgttctcaatgcgcaccgtcacctggtaagtgcctgaatgcacgcggcragcggcccggatgaacaggatggtgtctgtggggctgttgcggatgctcacctcctcgcctgccaggggctgcccctctttggtccaggtcacctgaggcyrgggcttgccctgaggggaggaaaagcttaaccctgaacctggatcactccaagggccggccgccaccccagcctctggtacctcagatcaggccagccctgagacatcagtccactggatgggaacaacacactatagcctctctcccctgggggacagggaagggggccagtcccacctggaaagggatgagaaggttcacaggctccccgaccttcttctgaatggtctggcgcaggtgcctgggcagctgaagccgtggccgttctgtgggtataragtgggtagctaagtgagggcccgccacagctctgaggggctccacagctccaacctcccttgagacaaggcccagagagctgcagctaagaaaaaagctgcctgctgggccctgcgcctcctttagctcctgctaacacagcaactccaggctgcccaagcccagctggcttccccgagcctcaccacttcaaaaggcagggatcagagagggtaagcaacttgactgaagtcacacagctagtaagtcatagaccagggtgtaagcctgggctttgacaccctatgccctgtgttgttaccacctgagtttgctgcctcgttccagctttgagaaccaatccttacaaaagatggaccctttgttgggacaaggaacaaaggaatgggaagtggatcccagagggaccaatctgactacatagacaatatttacctgttggagctgagacactcctggaagagagcttgggtactgtggcttttactttccctgttccagaactaagggactgacatacaccaagagagccctttctgcactttttttttttttgagacgttgtctcactctgtcacccagactggagtgcaatagtgtgatctcagctcattgcaactgccacctcccgggtccaagcgattcttctgcctcagcctcccaagtagttgagggactacaggcacgcgccaccacacctggctagtttttgtatttttagtagagacagggtttcactatgttggccaggctggtctcaaactcctgacctcaagtgatctgcctgccttggcctcctaaagtgctgggattacaggcttgagccactgtgcctggccaccctctctgcactttttccctaggcctagcgcatggacgatggctccaacccctcctgtctctgcccagcgttctgggcagagcattctgggcctccccaactgtccccacctccactggacaccaagggcctggggtgtcaatggcgggtcttgtgactgcacaaaggggcactcacrcaggatctcctgcactgtcaccggctccgtggtggtaacaggggctccaggccctgccataktgtgtgcccgcactcggaaaagcagccgggcccccgtgggcaggtccttcaccagtatcgatgtgtgctctgtcagcccctgcagggcagccacccactctgagcctgggggtggggagggggaggcaaggccacaggctgtgtcaccactgacaccccactcccactgcccactcctctgataggaatctccaggatttaaatatgtttttttaaatttttatttgtttatttatttttgagatggagtttcgctcttgtctcccaggctggagtgcaatggcatgatcttggctcaccgcaacttctgcctcccgagttcaagtgattctcctgcctcagcctcccgcgtagctgggatcacaggtgcccaccaccacacccggctaattttgtatttttagtagagacggggtttctccacgttggtcagactggtctcgaactcccgacctcaggtgatccgcccaccttggcctcccaaagtgctgggattacaggcgtaagccatcgcgcctggccttaaatatgtttttaaaatgtagttgctgatttcgcactgctcaaagaagtgttacagtcagctttactctgcatttgtttttcactaggcaagcttttttacttctgaaaacaggacagatatttctctgggtgtcctcaactttcggcaaaagtgggcctaaaaaacttgactacaggtgaatctgctcaatggcaaggtgagcatgttcttcctttggggaggggggttgggggcggggacactcacagccctctgggcagtactccacgctgtagccatccaggcctcctgctcccaygcgctctgggggccgccacttgagggagaccgtggtgtcagagacgtcctctactgccaggtgggtgggttcgctggggggacctgggcagaggagaggtcagagag

SEQ ID NO: 17713 - DNA, 60486 bp, Homo sapiens
actgcagatgaagattaaaatctaaacacaaatacttaatgtaggaaaaaatgcaggataatatttttacaatttcagtatgcatatgcagaaggatttcttaatcagaaaataaagatacagtataaacaaaaagaaagttaaacaaagataaattataagcaacagggttcctacaagtgacaatgatgctgaacatcaccagtaatcatgaacttgaaaaagaaaagacaaaatagatcatgctcccctccccatcagattggtaaaattttaaatgagtgctgggaaaatatatacacataagcattgctagtgagaaggtaagttggcattttagaaagttgatgagatagtatctataaatttgaaatgtatatacatagcaaattcacaatggggacagattcattatacaaaaatacttcggcatgccccaaagtataaatatgttaggacagccattgaattctattgtttgtagtaaattgttttagtccaaacactaattcctctgtagcaaacataggatctaataaaatggattatgtgtggaaatcagtcctctttagaaacctaaaggaccaagtgtatcctgattaaaaagataaaacgctttctttctttctttttgtttttgtttttttgtttgtttgtttcgagacagaggctcgctctgttgccaggctggagtgcagtggcgtgatctcggctcactgcaacctctgcctcccgggtttaagcgattctcgtgcatcagtctcccgtgcagctgggactacaggcgcacgccaccacacccagctaatttttgtagtttaagtagagacggggtttcaccatgttggccaggatggtctcaatctcttgacctcatgatccacctgcctcagtctcccaaagtgctttttgataattttgagaaatgatggaagcatattagaatgaaaacaacctgaggatgtgcttttatctttgtatattcaaatattttttctcattaaaaagcagaaagtccgggtatgatggttcatgcctgtaaccctaacactttgcggggccgagataggaagatcccgtgaggtcaggactttgaggctagcctgagcaacatggtaggaccctgtctccataaaaagcttaagaaaaaaattagcggggcgtggtggagtgcacctgtagtcttagctatttgggaggctgagatgggaggatcacttgagcctaggagttcaaggctgcactgagctatgatctaaccactgtactccagcctgggcaacagagcaagaccctgtctctgaaaaaaaaaaatacacacacacacacacacacacacacacacacacgttagtgggatagcacaaatgagaaaaactctgctctttgatcactgagtacatctctgtagatatatatttccttcactgcagattttgcccaagatacttcgtcaaagacaaagccagtacaccctctaatagggtgaatatggttatgccacctactgagcttgtttttgatactagttaatatgtaaccagatgaaattgtcattatcgtcactgtcaggactatgggaagcttaagtgttctcttttcaaggacaatgtgcgctaactgtacaattggtacaattaaataagttatattcagttcctgggaagcactatagcaatacaaggagaaaatttgattctatttatttttgttaaggcccacctacctcctaatcctaatttctctcatttcccaaatattccttgtttgttcttactgttatgtgttttcctgtattttgctcttctactttcttttccatggactatctttttcccttcctttttttcgctctacccctttacctcagctttctagcagtatttgctaaatacttcaaaactgtatagaactggttcaaattgtgtgctcccttttctgtcaagaacttgctactcaggtaacccaattggtgatttttcctggaaacactgatggatgctgttcctatagcgaaacccagaacagagatgaaatagatgtcatcctcagccattagcattcaaactataaaaattaatttacactggtatagtaaggatcagaatgtcaaagctgtgttacacctagcatcttgtatgaaactaccccattaaggtgagaccacagatattattgccccactattggcatgaaagctgaggctcagagcagttaactgagttacccaggaccacacagctaagttagaagtagggctcaggtgtcctggcaactaactggtccagttattttttctctcaagctcgttttccctctcctaaagaataggaggctctgtcgtggtgaaaggcgattttagtaatactttcctttttatctgtgattataatgaatgcggcatctctcccattaaggatcattcctccacccacattcttaatacatctgctgcatgcatccttcagagacctccctctgggatcatcccttctcactccaaaaagctcaacttctcccctgtcatttgtacctcccactcagcatttttagaagcaatatttcattcaaacttattcaagtttatttccacctaaagaaatattcctttcaccctggcatctccgtcaggtactgctctgttgtttttctccccttcagacaaactgccaaactggctctagttcctcacattccccatcaccctcagcaagcttctgccccacaccggcactgaaacagctgaatcccaatgtccttgtccttaaacccagcagaaaaaaaaaatcaatcaattatttgatttcacagcggcacttgacatgggtagccaggaatttatcaatgacaacctttacagatcatctttgtaatttatcatgaggcatcaaatgaatgctattaacattaatccctcctattttaagtcattaatccaagtaaatgctcacttatttctagcgtcttagaaaccatttaaattatgttacattatgaatcaatacattataaaattataccatcatttgtaataattttttaaaatgttgtgtgctattaacattgatgccttggtataaagtcatgatcattctggtctagtagcaatcttctattgactattctcttactaaagcggtcccttccgtgggactcagagacctcacactctcctgcctgtgtttcttcctctctaattggcccttcttgctccacttgggtgctcctgcccattgcctagacaagagcattccctgtaactctgtcttgggctctttttctcttttcatcaacatcttctacgtgggtattatcatccatttccatggcatcagcttgcccaataaactgataaatccatagtctctataagtacagcagatctcatcaagctagtggcattcagactgctttaactttaaccaaaaataagggattttgtacatgttcaataagcagttcccactgtgacactgtaatcacattttcacaattgtgacctaggacacttagagtaaaggatacagatgattgagacagaaatagtgacaaagaaaaataaggttaggatatagattttaatgctgtaacagacctcaaaatacaatggcttaactaagagaatgcatttctctgtcacataaaggtcccaactggcgtagacttttgatgactcaagggctcaggctgtgcctggtttgtggttctgccttccttaacacatggcttccatctgatgagctacagcagtacctatcactagtcagcatgtccacattccagcctgggcaaggaagaaaggggaagcgcagaactgtacccttccttttttaagtcatgaactgaaagttgcatgtatcacttccacttgccctccagtcaccagaacttagtcatatgccatacccagcttcaagggagtgggttaaaaacatagaagtcaactaggcagtctgcacccagcaaaggatcgggagttctattattaaagcagaattggagaagtggtaacaggaaacaaccaccagcctctgctgcatgtatatgaaacagatgtttcccaaatcactattctcacttattctgtctgatacactgtattttttattatattctctttcattttttaaaatcctggtcatgactcacagggcatgatgttacaacccacttagatgctaacaccataatctgaaaaatattacctatattatgtctaatattggccacttgaagtatggctagcctaaattgatctatgttgtaagtataaaattcacaccagcttgtgaaaacaaattatgaaaaaaaagtctttaagatatcattaacaattttatattggctaaatgttgaaatgatcatattttggatatattggattaaataaaatacactattaaaattaatttaatgtttctctttatgtggttactagaaaatttaaaatttaaaattacacagggcgatcacattctatttctagtagaccacactgctgtaagctcaagattcaaatgtcaaactcctgtgaatattaatacgtgaatatcccacaagcacttactccatcttcccaaccctcagcccttctgtcctccttctgctcccaccaatctgtgtttcttctgtttcactcacccagctaaaggcaacacaattcactccgtgacgagccaggaaaatggaaagacacattttcctttattcctcacattgatatattcactgagcactataattacctcttaaatatgatataaatctgcaagctcttttcaataccaccacaaattccatagttcaaaatgccatcagctttcacctatattattacaccagctcccatctggtcttcctgcatcctggatcacctctttctagctgccctttcaaatttcaataagagcaagctttccaggaaacaaacctgaagtcaatccactgagtactcctctgaataccttaatattgttgacaaattcctttctgatttgaagtatcagaaaggaatatttcctccataccaaatagttttcatttcatgcatgtgccgtgattcttctccctcctttgcatctgtcattcgttatgcttagaaagctcttttcatctctttgttcttcgagacaaccactactcatacttcagagcttaatttacattttgctttccctcaaaatttttttaaaaggttccaggtctgggttatgtgctctcttatgtgctcccagagcatcctgaacttctgcaataatatgtttggctactgtattttatacagtagttttatattgtattttaactgtattttatacagtaggtgttatattgtattttatacagtagttgtttttctgtctgtttttgccccaacaagaatgtaaaatctttaagtgcctgttttcatacttatttgaccaccctatctctagaatcttgcatgatgtctagccctagtaggatcaaaaaatacttacaaagcaactgaatagctacatgaatagatggatgaataaatgcatgggtggatggatggattaatgaaatcatttatatgacttaaagtttgcagaggagtatcatatttggaaggcagtaaggaagtctgtgtagtcgatggtaaaggcaattgggaagtttgttaggcacaataggtcaaaatttgtttttgaagtcctgttacttcacgtttctttgtttcactttcttaaaacaggaaactcttttctatgatcattcttccagggcctggctcttcatctgcaacccagtaatatccctaatgtcaaaaagctactggtttaattcgtgccattttcaaagaggactactgaattctgatgtggcttcaaacatttaggttaggcatatctaatggagaacttgcagccacactgacttgtagtgaaatatctattttgagcctgcccagtgttgcttaaattgtagttttccttgccagctattcatacaagagatgtgagaagcaccataaaaggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagrtcttgtgtgggtggaacttcctgtttgcacacagagcagcataaagcccagttgctttgggaagtgtttgggaccagatggattgtagggagtagggtacaatacagtctgktctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtcyttcatttattgcagatttttctttatatcmttcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacarctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaagaccttattagctgcttaccacaactgagactgtgaagtaatggctcactttctttgaggctcagattccatatctgtggagtggaagcgagtgcttaccatacaattttcacagggctgctgaatgtgtgtatgtatgtatgtgtgtatatatattttaatgaaaattctataatttgattagtttttgtaatgtccgcatgactgagagcttgcttactttttacagcaacttgaaggtaaaaatagattttacaacatgaacaaatgtaactacatatttttatttgaattcagatgttcacaaattgttccttaaagtgaagcatgcctacaagttttaatctgtttaagacctacctcaagtaaaatgttcactgccatggcatgtgagggaaaagggaaataattcttatgcatggccttcaacrgccaaatttcatgctcatcagtrcatcttctcttggtgtagaactgatgatgataattatgatgatggaaaaaagtgctgttgatagcaatgcstctcttccttcactttcctctaactgaaccgtctcattcccaggcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttgstaagaactgcaggaaggaatccaaatgtagcaaactaagtatagaaattaaggagcaatgcatgactmtccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggactgacaggaacacatcactccacactacttctaagagtaaaaattgtagaaattaccctgagcaaaggtgtaatatctcttcagagttgtccacatgtgagatgcttacagcctagtgtcagtaaaatacggggtttttttccatagcctgtaaaacatgcttcgaccatgcccttttagcatgtaatatcagcctggtaaagctcagcgtataattgaatcaagactgtttctgtgagctgtatgaaggtgtgaatctcacttacaacctctcttactgatttattttcctccaccttgtgtcctgtctccccatttgtaaaatggcagaagtgattcctgtccatgccaactttccctgctgagaacaagggagtgaagttaagtaagaagggcaagatctccagggaagagtgcaacagcaaataggggaggagacctgcgggtgctgaatggggtttcaggatcggtcctgtatttcaggtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacaggtatgaagaagcctacagacaggacamcttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctatacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctccaaagacaaaagattatggcctagttcttgtttctctttctctcatacccacatccacttcactggaaaatcatgttggcttaaaatatattcagactatttcttatcatctgaactactgctgcaagctagtcctagtcaatgtcatctctaaataagatcattacaataaccttcaaagtggtctcccagcttctactttcactcctctgtctaaaatgaggcaccacacccatcactctgtcagcctaacttggctttgtttttctatttgcacttaccaccattctatacgtattgatttttaaaaatctgcctatttctattataacataagctccattaaaacatggtttattgttcttttgtgcgtggttatattctcaatacctagaatgatacacagcgcatgagaaggtacttaataaagattagtttttaaaaatgaataaacattcatagtagcttcttatcaatgtttattcatttttaaaagtaatatttattaaactaaatttattaatgaaatatgtccattcctcctcattcttagaactacrtaagaattctatgacccatcttaatgattacatctgaacatatttacttatagttacataagtgtttatttctcaacctgtaaaattgcatagcaaaggattgawcttcactaggatgctataagcacttaagacatgttaatccatttttagtaaatggcactttacatgtatatttgttgctgaaggcctagtaagttcttaacattatttattaattgcttaaaatagattaatgaaaagttctataaaatttaatctggaatatttctgtatttcactatagagggaattattctatatgaaactaatttagattttttaaactttttattgtttttaatttttgtggaaacatagcaggtatatatatttatgggttacatgagatattttgatacaggcatgcagtgcaygataatgattatggatgataatcattatcattatccatatcattatccaatcatggataatgattattatcatgcattgcatgcctgtatcaataaatggagtacccatcccctcaaacatttattctttgtgttacgaacaaatccaattatacttttagttatttttaaatgtacaattaaattattttttactatactcaccctgttatgctagcaaatactagctgctttgcttataaatgagatttaagaatatttgaaaataattataaacttcttttttcttttgtctttcagattccactagtatacattcaggtaagcaacatgaaacattccatattaaaaggaaagcaatacatatagggaaaatgttcttatttcagaggtttttacaatatctcagaaacttgtcattaaaggagaagccttcaaactcccatagagctagatggctataactcatctcctctactcaccctttactactaccccatttgmcctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttmacatagcttcgttattttctgtagcaatatttaataccaacccccaaaattaaaacattcttgttttaatggagttttccataattaattaagcacacagtgatctctcatagtccctcaactgaaatcttcatttgagaggaggatagataagaatagattggagagcagagctaccttttcagagccctaaaatattattagggaactgttacagggaacctgaaaataggaattcccccaaagttgaaaaccaatcaccaaccttctttatcaccaatcaacagttcttcccaagtttgaagtacaagtaacagtgccaaagataatcaccatcttggaagaagagatgaatgtatcagtgtgtggcctgtgagttcattttttaaaaatcttttgtgggggattatttaaaagagactcaccatttgggatattttaactactctctccgggagcagtggcaacacaaaaattttaagtgctttgacagcatcctcatctgtagaatgttattctcctgttgcttttctatttttattttctttcacgttcttatcagtattattctatcatgaggtaagaaactgtttctagagaggttatgctaataggattgattctgaaagtgacaaaactgcacacacacacacacacaaaatgggaagggtggatagtgttgaagggtattggttctgccttaaccaaaaataaccaaacgtatattagggagataattaacacatggctataggggaaattcaatcatcaacagatcatttacctgaccttgcatgcttactggaaaaatcacttagattcagaatttgtagagataggcatacaactgaaatctcatctaactcactagtccacctaaggcgggtctacatacctgtctgcactgacatttttacgaagagactgaacgtgatttctcaagacagtctgttccaaccttgaaaagtcttgtttcctggatcttatgttcccatccatggtggcacacagtagcagtagcaggaagagcaggtatagtcctgyccaaagatcacacatgtaatacacctactattcagctaggcccctgctccagttctgtctcacagtgatggccaagttcctggttcctcataactggtgtgatcttgcaaatagacatacagaggacattctcaaataggaaaggagacaaatgcacttggaaacccagcaattgtctatgacatatttacgacacaatcccacttttgtaaaaaagtaaacaggcccggcgtggtggctcacgcctgtaatcccagcactttgggaggctgaggtgggcagatcacgaggtcaggagatcaagaccatcctggctaacatggtgaaaccccgtctctactaaaaaatacaaaaaattagccaggcatggtggccagcgcctgtagtcccagctacttgggaagctgaggcaggagaatggcatgaacccaggaggtggaggttgcagtgagccaagatygcaccactgcactccagcctgggcgacagagcgagactccatctcaaaaataaaataaaataaaataaaataaaataaacaagtgaaactcgatatagagatggctgcacatggggagaggatgatggaagaagagacactatcgtactaatagtttgtattcctaggtagacttgagggcgtttgggttttttttgttctgttttgttttgtttgtttcgtcttgctggtattgtttctcttttaagaacgggtttaagttttataataagaaagacttttttaagataaaactaaaaaaaaacgaggaaaaaaaagaaatgataaaagaagaatgtaaatttcagcatgttgcaatggagatttctataagagccattagtgactcttgtcttcaatattgtgtgagcccagcagagagcagagggaagtacagacagggaatatactgtagctaaaggggagatataaatagctagaaaatggggaggttcrgtgtctgctctgattcctttgggaatgbtctcatgacagatacacatatgggaagcctgtccctggacatgtgactgtgagcatttgcagaaagtatagtgacgcttccgactgccacggtgaagattcacaggctttctgtgagaaattcagtggacaggtaggttgaacactattttttctagagaatagcgataaaggcattgttgaaaagcagtgagttgcagcatttttctgacgcaggaagagaacaatctagaagagaattccatgttggctattgtaatttttcaaaaaaaatcatgaacttagcacaatgggaattatttatttctcgtaattgcccattgtgagtgtttcagaacgatagacrctgagccatctaaagcctccatgggcattcacttctacaaaggaaggaaaaaaccatacacctcttaattgccttagctggccaggccatcagttctgctctctctgtgaacaagaacctatcacatggccccaccaagatgccagagagttgacaaacacagtccccatatagaaggccgcttcccagccacagctgaatattatggaggaggaaccagactttgatgaggagttctaatggtcaagagcagatgtactgtgtatttcaaaatagcaagtggacaggacttgaactatttccaacacatagaaatgatacatacttgagttggtaggcaccctaaatcccgcratgtgatcattacacattctctgcatgtaacaaaatatctcgtgtaccccataaatatgtataaatattatgcatcctttgtacaaaaaaaattactcctcaaattttaagacatttctatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcattatatttttgtattttattttctcccttcttagctaaacagccatggctgcttctatcagcaagtaaaaaccaaggtcttccagctgaagaggaaggagtatgaaatgaaacttcacactgaggcccagatccaagaagaaggaacaggtttgtgtacwacatgggtataagagaaaacacaacaggcattgattttcttagccaaataatgaattgtaagttggggggaggtgatagaattttagagacatcattcttcccaaaaataacagatttttttctcttttttcagtggtggaattgactggaaggcagtccagtgaaatcacaagaaccataaccaaactctcatttgtgaaagtggactcacactttcracagggaattcccttctttgggcaggtggagtattytccagttcactcatcaacccatgtactgttacctaattagcacaatagttatggtttgtgctaaaaccatgcctggttaatgttatcatttaatataaccaaaagtataaaatatcaccaaggcttgattagtataaccaaaggtataaaactacataaaaatagatttattcttctgtaaatttgtgtatgaaatgtatgtaattatcctaaggccttattaaaattagtagagttttccccccttcttttgaaacagcattgtacaagtcactcaatctccttctcatggtttaccaggcagtctcaggtttttatgacattttctcacaagaatctcaaaattcatgctgaccagtttcattacgatgctaacactaactttgtatggaaacaggtgggtaggtggttttaatttttattttgaagtattaaagattctacaataatgtttatttcatggatagtatatttacactatttttctataacaagtatatttctaaaacagtgaacatggggtaaaacactgctatttaaggttctcagatttttgaattatgaattttcatgttatctaccaaaaaaatcttctcttacaatttttctgttgtcagcagatgtgcaaatggatctttatgactctagaagtctgagatcacagttacatgtgcctcaatgtgtatttactgtgtatcattttcttaatgtaaatgttacaggatttcagctatgaagggtgtaaaagaggcatagactcaacaaagtggagtacattctagaaggcttggttatgtcatgacaccaaaatgtattcaacttcctaaaatgaaagtgtagctcatttgtaaatttctcagaaagatagtgtactttgtaagtacattttattgctgttaaatatcctatttgtcataagactctctagctagaagaaaatcagaattatgtgcctattcttgtctttgtacatgcagccaacatttcactggcaaacttagattttgtaaatcaattatgagtactgatgggggtcagcctattgttcttcctgctaccaactgtagcttatactgaaaaagaattgccacctttacaatctgaactggactactcaactgccaatacaatattagcagtaaattagatttggcaacttatttaatactgtgtgcctcttttcaattttatatttttcacatgggaagtgtgtcataaaatctgcctaccttccaaaaggctgaagatctaggttgagaagcagagaccatgtctaaggcaactggagaaacacacaggacaatgtattggcaattgtttacttgtgcacttatgagacttcagacactaatctataggaagttaatggtccactccaaaataggtgtttggggcacaaataaatttagttaatagattaatagattaaaatatttcattatcatattactctagtgctctgtgactctctaagagttatatataataatacacagcacttccaaaatatctagaagacatttttcaggtcactcttgttattatccctatcactctctatcccttcacactgctctgtttttcttcttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagttattaccaatataactaatccacagcttttaatcttcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtaagtttggaaagaaattaccaatgacatgaagtagccttggaaacaaggttgcaacctaagggtgagaaaatttccaaactgtgtctagttctatggagagaaaaaaactagcaattagaaaccrattgaaggttaacttttttaaagtttatgaaaagaaggcagtatattgtgattaaaagtgcgggttagactttagcagtgttgctgggaacgtaaaatggcggagccactatgaaaaacagtatagtagttcctgaaaaaattaaaaaatagaattaccaaatgatccagtaatcctacttctggacatatattcaaaagaatcgaaaacggggtctcaaagagctatttgcacacccgtgttcatagccgcactattcacaatagctgagagatcgaggctacccaaatgtccatcaagggatgaacaggtaaacaaaatgtggtatataaatacaacagaatattatgcagyctgagaagggaagaaaatcctgtcacatgctacagcatgaatgatccttgaggacgttatggtaagtgaaataagctagtcacaaaaagaccaatactrtatgattcacgtacatggggtttctaaagtagtcaaagtcatagaaacagaaaacaggatggtggttgccaagggctagggaaagagagaaatggggaattcctcttattggtattcaggtttagttttacaagatgaaaagttctggagatctgttgcacaacagatatacttaatactaccaaactgtacactaaagaataatgaagatggtaattttatgttgtgtgtgtgtgtgtgtttataataacttttttgaaaagtgtgaattccagaatctgaatcagataaagtggttaaaaatactggctcaaccctattttaaggaattaactaaaacctctgtgcttcatttccttatctgtaaaatgattgcaatactaacacctgactcttggggtggttgtgaagattaagtgaaatmatacatgttgaatcacttagtaagccccctttaactgttagatacttttactataaaagccaattctaacataattagcatttagttttaaatatatatactccaaaaattattaccttactttattttgtcttgctattctaattttctccagatgacctgttcataccaatataagttattcggtatagcatgcagtcctctattcatcaagagagatgtagacatgtctatagatacatggatatacaatacatatttaatatatattacataatcatggtaatggaaaacgcctgcctctttagagttttaccttgttatagagaaataaataatacattttatttatttagctttaatagatggcataaaagcacctccctctaatttgaatgtttactcatttcaaaaagtgtcttgaatgctttccacgtgccagcactgtgctagtcttgacaatgaaattattatttctacctgttccctgtttggggtgatcatatatrtgttgtcaccaaaatatacattaagatatgaacaaaatgttttgctcaaggattcactagtgctattgggagctggggatgaaggtagaggaagcctgaaaggagctaaggaataacttctacaggaagaaaagttggaaatataacccaaatagggcctctgaggtattagaatccagattgcagggagcattaaaaatagtcagcctaggccaggcacggtagctcacgcctgtaatcccagcactttgggaggctgaggtgggtggattgcgtgaggccaggagwtcgagacgagcctaggcaacgtggtgaaaccctgtctctacaaaatatacaaaaaattagctgggtggggtggcatgcacctgtagtcctagcaactcaggaggctgactgggaggatcacttgagccccagaggcagagattgcactgagccaagattgtgccactgtactccagcatgggcgccagagcaaaaccctgtctcaaaaaaataataataatagcaatcagcctaagatagcccagaagagstagacttcagctaattcatcagctcagctcttaaaccaatgctttctaccaatgtcttctcagacccctaaggttacaatattttatttattcataatacccattcaaaatccaccctaaaagaggcagctgctttctgaaagcacagttcttccatttctagagattatttactctcctcaatgaagtttcatagctccagtgtctctaattgcacaggtaaagcagtcaaagaaatttcaagcaagctaatcagagcaaaggatgcctccttttatgctcttaagaaatataaatctcaatcccaggaggctctgcagtgtaaagtcacaaagcatgcctacatttgaagcagagaaasaaaatcaggggtccttctcccacttttcattgtggawcaaaagatttctagctactagttaaggtaggacagtaaacttacgtagttttgtgagaacattaatctttatgacgtataatctaaaaataatataatttttctaattcattaggtcaattacaaggatcrtagtccctgttayggctaccagtgggtrtcagaagaacacgaagaggcacatcacactgcttatcttgtgttctccccaagcaagagctttgtccaccttragcccatgtctcatgaactaccctgtggccatactcagacagtccaggcacattatattctgaatggaggcaccctgctggggctgaagaagctctccttctattatctggtgagaagggaggttactgcgttgacttcactgtagacaaaagctctctgtggagcaagtaatcatgaagctctttagatgtcattacttcaacttcttatccatgttccttttgaaagtttgatttctcttgaggtgaattattgccrgcagggactcaataaaacaagtatattgaagtgagactgaagcgtgttctctctggcacatttaatttctttttatttccttttttgcagataatggcaaagggaggcattgtccgaactgggactcatggactgcttgtgaagcaggaagacagtgagtatttccatcatctctgcattgctgccccattctgacccattcagccttacaccacggaagtatcagaatactttccctttttttccataggtttttgggggaacaggtggtgtttggtcacatgaatgaataaattctttggtagtgatttccgagattttggtgcacccatcacccgagcagtatacattgtacccaatttgcagtcttttatccctcacccccttccacccttccccctgaatccacaaagtccattgtatcattcttatgcctttgcatcctcataacttagctcccacttcctaatagcttagctgccacttcctaatagcttagctcctacttctgagtgagaagatatgatgtttggttttccattcctgagctgggaatatcaggaatactttcaagtaaygagagaccatttccatctaatattaattaaaagaaagttgagggagggaaaacaataatggtttttttctcaccctttatcaaatatgtgttgtcttttttttcagcctattttctttgcgttatttaaaatattggtgtgggccagctatgatggcttacgcctgtaatcccagtactttgggagaacgggatgggaggatctcttgaggtcaggagtttgagaccagcctggtcaacatagtgagaccccatctctataaaagtaaataaataaataaataaataaataagaacaaagggggaaaaataaaatacataaaatattgttgtgtataatctatgcttattccagatttttaaaccataaatattcttgaacctcttctcaaaatgagaattgtgttagagaatggggtggagaaaatgtacgatttcaaggtatgttgtatataccaggtcttgtgctgagtcatttatgtcatttatattattataaatatcttttttccctttcaagatagttatgatttatgaagcattaaattgggtacttctaccgactgaagcggactcttgccatgagcaaatatgtcataatataaacctttgaaggttgctcctagtctagtagactctaaaagataacttgctagaaaagtatcagtaatctactctctcattagttcttgtagcaacacagaagcaccatagcagactgaaggaaacttaatgcaacctctaaagaatctacataggcatcaaaaaataacttctgaaggagcatggtgttcctcttatggagaaagaaccaaatattggctcatagaaggttaaagagcatgtagcatgaatacaatgtgttgaactcttactcttacatctcataacttcaggttctatttccctcttctagtatgaggcctagatcaaatggtagtgaattggatgtcttcatacccttaactagcatcagaacattaggtgggtgagctgaagcttaaagctggtgaaaaatcaacagagtatatgatttatgagaggagagagggctttgatagggtttttttctaaagctagagtccttagaggtaatcatccatttgttacatctactgtttattatgtctgttacatctactaatggaaatagtcattaacctatgatggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagwcattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagccaaaagaaaaatgcaagagcacctagacccatgcatgtcccaccacaattaatragcaccttgccgtgtatcaaagataaaaatggcatttcatgactagtaatttataagaataattagaaataattctactggctcaagtgattcttgagaatgaaagagaagtgtagggaacaaaaagcttcaggattgacacaatgccaaccctccacgaagtcaagcagagtggttatacattgtacatgaggaacactctgcaaatgcgagygaatgcatgggtaaacctggaaatttgcttttctgaccttttgttccaatttcacaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattwtatatatatatatatataactactcacttctgcagttaaaaaaataaacaaaatacaatatattgaatcaaataaaagaatttttaaaaggacaaaatgtgatgaaaattaacaaccaaaaaaggactcgttattcagacacgttaagcttcttgctcaagagcacatagcaatacaaattcaaatcttctgattgtgtcaggacatccgtatatgcaaggctggagagaatacagagcagattgtgaaaagtgctatatgagaagtgcagttatgcaaaataaaagaaaggattaactgagcaaccggggaagccgttcgaaaattatatatttaaaatgtaaaaagaccatacagtacccaaagtccttaaaatcccagagctccatgcaaccagtaataggagttgtcaaactagtttcaacatttcaaaaagcctaacaraagtgatacatatacctgcactgaggctatacaggctaaatgaaatatcagatttccgtttttataagaattatggctgggcctggtggctcacgcctgtaatcccaacactgggaggccaaggcaggcagatmacttgagrtcaggagtttgagaccagtctggccaatataatgaaaccccgtatctactaaaaatacaaaaattagtcagacgtggtggcgggcgcctgtcatcccagctactcaggaggctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaaacttagggaaattgaactactatataattgacattgataactgaactctttgaaaatatggagctaatagaagaaataccaaaaggatatgctgaattggaacaacaaaaactagttaatagcatgtactaatagtagtttgctcacatcttcaaatttttaatatgagaccaattgtaataacctcttactgaagctttttctactaccataatttaacaaagagaaatttatatttttattttcctgaaatagaaacttataaaaaaatrtttcttacttgtttgtccttctaatgggattttaactgaaaatattagaatacttctaaaggaagcatcaagtacatttcaacagtaggatctcaagaggatatgtgggaaaataatatacrtgttttatacttttataatataattttataattctcaaagaatttttcaaattataacaaccctgatgggtagataaggcagacagtcctatttattaataataaagcagaagctttcagggatttagtagtagacctgagttaaaacaccaactcttctcaagctttgattagtgtcttaccaatgaaacactttgctgctactagtgtaggtcattcattcaacacatttatttaatgcccactgtgttctaggtattatactaagtgctagtagagatcaagcagtgagctactggaaagataaaaatgtatgtctcatggaacttacattgtctgtcccatagatgagacagacaataattatgcaatatgccacaataaaagcagggagaggaaatgagaaatgttaagatactttgagaaagtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagtgttgagtctagtggtggcctctgaactgtgtaacgaagtagtacttagtacttagatgagtacttagatggagtgtttggtttttcctaaaattgttaaacatcttcaaaatgaaaacactgtgtcaagaaaatgatccataccctctataaatcatcaaagcaatgagagcgctcaaagaaagacggatgttcattattcctgttcttttctccttgaacttaaaaaatgtcacaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtccrgcctgggcgacagagcgagactccgtctcaaaaaaaaaaaaaaaaaaaaaaaaaaaagtcacaaataagtttgcctttttgtctttcgtatttgtacaggtttacaacctgctaccagaaaaggacctcactggcttccctgggcctttgaatgaccaggacratgaagactgcatcaatcgtcataatgtctatattaatggaatcacatatactccagtatcaagtacaaatgaaaaggatatgtacagcttcctagaggtaaactccttatgttgcagatggtctgatcttaagcttcttaaaatattacacatggaaaagagtctgtatttgaatgccttcatgtcctagttgagggtaatgggatataaagaggtaagtggcttctctactaatagcagcagatctgcgaaaagctgctgaactaagctggaactttttggagtattattcaagttttcttttttcacaggaattaattgctctgtgatgtttattaaaatcacatatacaaaataattactgttgaaagagtttaatgaaaagaataaaattacatccttaagtatataaatatcccttctacagatgtgaatgttaaaagtttaatttaagttaactggattgcttgtcaaattcaataaaaagaagtagctacctatgtatattttataatatatatttactgattagatgataattttctttgcaggacatgggcttaaaggcattcaccaactcaaagattcgtaaacccaaaatgtgtccacagcttcaacagtatgaaatgcatggacctgaaggtctacrtgtaggtttttatggtaaacaaaaaattaataaatatatattgcctaatatattcaccaaattttaaattttttaaaagatacaatgtgacaaaaattaacaaacaaaaaggacatgtgagtcatacatattaaggttattgctcaaggtcatatagtaatataaactcaaattctagtaaatggaggtacatgtgttaggctgaaaggaaagagaaagtttccaagcgtaggattagtgtaaacagaaatagaaatgttcacacaacaacactacattctccatcagtcaggtaaaaaagctgttcaacttccccaaaacatcagccaatatttatgttggaaccacacacattcatcaatgacatgagctacttctttgatgaactgaatagtaatcaagcatttatttatagtcccatattgtcaaatcatgattgaggataagttgagtacagagaaaagagggtcaaaaatcaaggaaagcatttaaggagaatcagttggctctatggaattcactatgaagcctaccgcatattttattatttataaattatattgtataatcctttatcagtaagatatatagtaaatttatgcatgtataggtatatatatatatatatatatatatatatatatgcacaatttttttttccagagagctggttgtgaaatattgaccagcacacccttaatagaaggtgaatagagtgaaggaaactaactgtaatcttctgacacgatagagaataaaaagtctttattattattaaacttttccctcctgtaaactgtttctcaaagccactgtcataacatgtgtgtcagtttttccttgctcctgcagaggagcacaccaatggaaacttggattcctgcccctcttcacggccttgtgtcataacactctccacttagcacagcggcagcagccacataggactccacagagtccttgtgccccacagacaatccaagcctctgtctgccaaagtctctatagcctctgcttatgaccctcctcccccagctcactcctagcttattcttgtttttttttgttgtttgtttgtttgtttgtttgtttgagacgaagtctcactctgtcgctcaggtcgcccaggctggagtgcagtggcgccgtctcggcctcggcctctcaaagtgctgggattacaggcatgagccaccgcgcccggcctctcctggcttgttaagtcawccaacatatttcctcctcaaagaagctttccttgatgacccaagcgccctctcctccttcctctctatttcatcagacgatttgttttttgttttttttttttggtggcaactattacattctctcataagctttatctgtatgtttattgtaatgtcttcttcctcactcaccatagagtcagatgtaatgggaagaggccatgcacgcctggtgcatgttgaagagcctcacacggagaccgtacgaaagtacttccctgagacatggatctgggatttggtggtggtaaagtaagtaacttcctgcatatgcaatatgcaacaatagaggtccctgactattttcaactctttgctagtttttctgtttttattgttttatatgtttatgatgtacaacatgatgttttgatatatatatatacacatacacatagtgaaatgattactacagtcaagcaaattaacacatccattagctcacattgttacctatttttgtgtgcatagcaagcacacctaaaatctatcctcttagccaagtttcagtatccaatacagtattatcaactrcagtcctcatgctgtactttagatttctaaatttattcatcctacgtaacttcaactttgtaccctttgacctgcttcttcccatccctgcaaccccaaccacctttctactctctgttcctatgtattcaacttcttttagcatccacatacaagtaagatcacgcagtacttgtcctgtgtctggcttatttcacttagcataatctcccccaggttcatccatgttgtcacaagtggcaggatcttcttccacttaaggctgaataatattccattacgcatagccacaatttatttatccattcacccagacacttaggttgtttttatatcttggcaactgtgaataatgctgtaatgaacaccaaaacacatatatctctacaaggtgcttatttcatttcctttgggagtatacccagaagagggatttctgggacatatggtagtttccattttaaaatttttgaggtatctccatactgttttccataatggctgtggcaatgtacatttgcaccaaggggagtgaacaaattccttccagagagacactggaaacagagttttatccstgaaacaagccagtggggcaggtggagagaaagagccggaatggccatatactccctttcaggctcctggagtcttgtttacttctccctttcactcccagatgcaggctgtttagaagcccaacccttaggagacagccagaaatgggagattttgcctgttctctctgtattgagccaaggggtggtgggggcrggtagccactggcattgctcaaaggcctatttaaaaccacctctgtgttcactgtggtctagggagactcctgattgcagagctccatctactcctggagctaggtgatttaggagccagacccttaggtacgagctgtaaacattggggtgcttgatgcatagacaaattattcccaggggtatgttcagacctggttttatccgtggggcgagccaggggaaggaggcatgggaagtgcccttactgcttttcagccttcctgtaagtctgtcgtttccctgctccttctgcttcccagtgcaggctagttagaagcccaacactcagtcagcaactgataaagtgggtagacgaagccsttccagggagaaactgggagctgttagctaatttttcagtactgaagtacttctttcaaacgcattgctaatttcaggagatgtttaacataaatacatcagctaagaagtcttactaatctaattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatrttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatmattcctagggattctctccctagaaaggatgtatttaactgcttacttwctgttcttcacttacactcctctccagctcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtccwaaactaccttcccaaatgcatccgggtaaggatctctttcctaaattaaatacaaggtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggggtgacaaaagtcagtactctattctcatgacagattctacaaggtttcaacctctacgatctcatatatttaacttttcgtagctcattcattatattaaacctaattttaaaagtcgtttgtgagcatcttacctttgctgaaaccataactgtttataagtcttgtatcctctgccgggagatccgggggaatggtcaaagttccagaccaaagaggtagagcagcatgccatcattacctttcccttcctctggtcccatcatgtgaaagagcaggttgcttccaaaataactcagatttacctgtgtaaatctgatacattaagatccacttaaatatatttcaggtacttgatcttcatttatatcatctttaatgtgaggcaacctgaaatctaaccaattcctcaagatgctttacttcaaacccattctccctctsttctccttccctctctactccctttcttatgtgtggtttcaggtcagtgtgcagctggaagcctctccygccttcctagctgtcccagtggagaaggaacaagygcctcactgcatctgtgcaaacgggcggcaaactgtgtcctgggcagtaaccccaaagtcattaggtgagcaaaaaactgctagagataattstctactcaaagattgtatatggcagtgggaaccttataktgagtgctacttccttcaggaaaagaccactagatgctgcgatttttttcctttgccttttattctaagatgcctacaaggatatcctcaacatctccaccttgaattctcagtatcattcacctctcatttgcatgtttccgttcctgcttctgtgttttaataaaacaaaagtttacagagcattgaacatttctaaatcttgagtttggaggcatggaggaaggggaagatgctattcatttctactggcctttttttwcaggaaatgtgaatttcactgtgagcgcagaggcactagagtctcaagagctgtgtgggactgaggtgccttcagttcctgaacacggaaggaaagacacagtcatcaagcctctgttggttgaagtaagtaaacctaaataatatatagtccacaataatatataatatatgtgggtaatataataatatatggatattttataatattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacaggatttcaccacgttggccaggctggtctcgaactcctggcctcaagtgatctgcccacctcagcttcccaaagtgctgggattataggtgtgagccaccatgcacagcctccctttgatttactttcttaatttttccttcatttgttcatgcatcgaactacctcctacgtatattgcttatatgtacagaattttcttagataatacagttcaaatccttctcttcactatccaaatatctgtggtccctccattaaaacacatgttctgaaggtcagtccattctcactagcttttctttcttttacctaaagcctgaaggactagagaaggaaacaacattcaactccctactttgtccatcaggtaagagtcaaccatcataatttaaaaaacattaaagtctaacatttaaagttcaaagaacatttatatattattcctacactttctctgtgatctaagacctgaagcaccatcaatgcatttgacaaatgtggaaaatagttcttaggaaggccaagtaatttgatcagaatatccctaggcctgcattctgagtcttgatcttttgcagcacctgtgcaaacaccaaatgactttctgaccagtgtatggtatgggcataggtagaaagtgggtagaatcaaaattaatattaccaaaagggatgtttccttaaataattaataatgcaaactatggacggctgaatttagggcattctaacactgagttttacatagccaacagtatttgataacgggattgctatttcccaaaggaaaagttgtcatggcctttaccattattgtcatattaatatctgtttgatgcctatcccgtacctaatgccctatcaaacatttgagaaggaactgaagaaacttacaggaaaaatttaatacactaagaaatttatcagcacaatgcattctcaccccaaaccaacattgaatcaacatcatacataggttcattgcctttctctgactacctacaaatttagtatgtttttcgtactaaatactttatctattcatctgttgccaagatgtaacacataaaatgtaccctaaaaacataacttccttgtcatttagccttatttctacatttaagtgaactgattacctaycattcaatccttttatcatgacttctccgtttctgagttactcattttgatgtatctcttaagtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagatgtatatgtttgtggwtgtgtgatttacatataataaactgtataagtttcattctataaatcactgtttgtttttcamtcagcatcctgtcttggagatttacctatgttaaattgtagatctaggtctttccttggaattgcttttaagcctataatataaatacatcacaattctgcttagtgttttagtcttcctatattggttttttcaactattcactagctttaaaaaattagttagttaattataataagagcctcttaatgaacatatgcaagtacagctagggtagatccaaaatgttaaattcctgagtcagagagcatatgcatagatatgcatagttttgtttggttggttgttgttgttgttctttaattacattgtaaactgaccatttataattgtatatatatacagcatacaaagtgatgttatgatttatgaataaaatgtgaaataattaaatcaagctaacctgaaatacttatgttttgtggtgggaacatttgaaattctctaascaagtttgaaacataaaatacactattattaactatattcaccatgctgtgcaatagatcccaaaaagaaaaaaatgtattccttctgtctgagactttgtgtcccttgaacaccaccttccttttactccagcttcatcctccataaccaccattctactctctgctcctgtgaatttgaatgttttagcttccacatacaaatgagaacatgcaatatttgttttcctatacctggcttatttcacataacataatctcctccagatttaatcatgctgccataaatagcagaatgttcttgttttttaaaatggaayggaattctatgtgtatataccaaattttctttatctgttcatctgttgatgacacttatgattccataactagacagacatcagtaatttgttagggattacattcaatatgtagattgctttgggtagtgtggacattttaacagtattaattcttccaatccatgaacattgtatttttttcatttatttgtgttctctttgatttctttcatcagtgttttataattttcactgtacatttcacctccttgattagatttatttctacatattgtttatagctattgtaaatgggattgtttttatttctttctcaatcattcattgttagtgaacagaaaatactactgatttttatgtgttaattttgtatcttgcaactttattgcattcatttataagttcttgcagccctttggtgaagtcttttgagcttccaatatataagataatgtcatcaccaacagtgaaaattttacttcttccttgtcaatttggatatttttcatttctttttcatgtttgattgctcttgctgctacttccagtgctactttgaaaataaatggtggcagtgggtatccttgtcttgttccagatcttaaaggaaagtctttcaattttccactgttaaatatgtaagctataggtttatcatacatgccctttattgtgttgagraacattgcttgtatatctaatttggtgagagttttatcataaaagagcattgaattctgtcaaatactttttctccatctaacaagatgatggtatggtttttacccttcattctgtaaatgtaatgtatcacatttattgatatgcatatgttgaacaatttttgcatctcagggataaatcccacttgactaggtagatgatccttttamtgtattgttggatttagtctgctagtttatttcgtgtggttggttggttggtttagttttttaagtgatgagcttttgctgtgttccccaggctggacttgaactcctgagttcaagcartcctaccacctcagccacccacaggtgtatgccaccatgcttagctgctatgctagtattttattgaggatttttgcatctatattcatcaagaatattggtctgtaattcttttttgtaatgtctttttatgacattggtatcagggtaatgcttgcctcataaaatgagcttgaaagtattccttcctcttccagcttttggcagagtttgagaaggattggtattcattctttttaaatgataagtagaacctagcagtgaagccaacagttattaggcttttctttaatggaaaactttttattactgattcaatctcyttactcattatttgtcagttcagattttctatttcttcatgattcagtcttggtagtatgtatatgtctaggaatgcattcatttcttctagatcatccaatttattggtgtatacttatgcataatagtctcttatgatcctttgtatttctgtggtatcagccataatttctctttcatttctgattttatatatttaaggcctccctcttttttcttagctaacctagctaaaagtttttgtctgtctttttaaaaaaacaattyrgtttcattgatcttttgtattctttttctagtctctatttgatttatttctgctctaatctttattattttcctttcttctgccaattttgagcttastttgttcttcttttcctacttctctgaggaatatcattagtatctttattggaaatttttcttcttttttggtgtttattgttataagctttcctcttagaattgcttttactttatgctatgttttgttatgctccatttccatgttcatttgtcttaagatatttttgaatttccttttaaatttctttattgacccattggctgttcaggagcatgtcatttaattttcatatatttgtgaattttttctaattcctcctgttactcatttctagttttcatagtattgtggtcagaaaagatacttgatacgatgaaacgatttcagtcttcttaaatttgctaagacttgttttgtgggctaaaatatgatctatcttggagaatgtttcttgtgtgcttgagatgaaatgttctgtatgtatccattaggtctatttgatctaaagtgttggtcaagttcaacgttttcttattaattttctttctggataatctatccatttttaaaagtgagatgttgaaattccctgatattactgcattgcaacatatctctcccttcaacctttaatatttgttttatatatttaggtgctccaatgttggatatgtatagatttacaattgttatatccttttgatgaattgacccttttatcattatataatgttctcctttgtctctttgtacagtttttgactttaagtctgttttgttgaatataagtatagctacccctgctctcttttagtccccatttacctagaacatctttttccttctcttcactttcagtctatgtgtgtccttaaaaattaggtgagtctcttgtaattagcatatgtttcggtcctgtttttttaaatccattcagtcactttatgtcttttaaatggggaatttagtccatttgcattcaaggtaattattaatttaaaaatgacttggtactaccattttgttgttttctggttgttttgcttctttgttcctcttttgctgtcttcctttgtggtctgatgttctgtagtggtatgatttgaatcttttaaaatttttgttctgtgcttctattaaagatttttgccttgctgttactatgrggtttacagtcaatttcaagctgataacaacttaactttgcattctttcactcccccacacacattttatgtcgttgatgtcagaatttacatattttgtaatgtgtatttattgacaatttatttttagctatgcttgttattaatattttgtcttttaacccttgtactagagataaaattgctttaaataccatcattacagtcatagagtattttgaatatggctctatattacttataccattaaattttgtgcttttgtgtttttgtattattaattaggggccttttgtttcagcttaaagaactcccttcagtaattcctgaaggcaggcctaatgttgacgactcccttagcttttagtttgtctgggaatgttttatttctccctcatttctgaaagacagctttgctggatgaagaattcttgattccatgttgtttttatttttgttttccttcagtactttgaatatattattccactctccctcagcctgccgggttmctgctaaaaatccatggatagttgtattggaattcctttgtatgtgatatgtttctttatcaccttctgcttttcagaatttttttttgtctttgatttttgatagtttaattattgtgtcttagtgagcagttctttcatttgaatttcactggagacctctgtgcctcctgtacttggatgctagcatctatcccctaattagggaagttttcagcccttactgcttttttttttttctgattctatactcttttttttcattattgctttaaatgtgctttatagtctctttcttcttcttctggactttctttaatgcaaaggtttgatttcatgatgatgtcccataatttccataggctttcttcattcttttgtctttctgctcttctgcctggataattccaaatactctatctttgagctcactgattcttctgcttgatcaagtctgctgttgagcttactttgaatttttaattttagtcattgtattctttatttccaggatttctatttggtttctttttgattgtttctatttattttttattttacaatattagctaagttgcagataattgtttctatttcttttttttttatactttaagttctagggtacatgtgcacaatgtgcaggtttattacatatgtatacatgtgccatgttggtgtgctgcacccattaactcgtcatttacattagctatatctcctaatgctatccctcccccatcccctcaccccacaacaggccccggtgtgtgatgttccccttcctgtgtccaagtgttctcattgttcaattcccacctatgagtgagaacatgcggtgtttgtttttctgtccttgcaatagtttgctgagaatgatggtttccagcttcatccatgtcccaggaaacaacaggtgctggagaggatgtggagaaataggaacacttttacactgttggtgggactataaactagttcaaccactgtggaagtcaatgtggcgattcctcagggatctagaactagaaatacatttgacccagccatcccattactgggtatatacccaaaggattataaatcatgctgctataaagacacatgcacacatatgtttattgtggcactattcacaatcgtttctatgtcaaacttctcagtttgttggtgtattgttttgcaaatttcatttaattttgtatttatatattcttgtagtccactgaatttcttcaagaggattattctgaattctttgtcagtgatttcatagatctttatttctatgaggtcaattttttgagcttggccagtttcttttggaggtgtcatcattccttgattcttcataatcctgtgtccttgcattgtttgtgcatttgaggagaaagccacttcttctggtttttataggtattctttggcagggataaaggtttgctatttagtctagcctataattctggaaagatcagttggtgacaaccttgagcaggcagagttttcatgggttccctagttggctgggccactgcctttgcycttatgtttggtagggccactggttgggccttgctctctggcaagatcactgttttgtctctgctatctggtggagctgctggctgggtactacaatggcctctggtcaggccagtcacaagatgtgttgcctggctggatgattctgctatttgggacctgaagttaggcagggtcacaatccgggctgtgaggttaggtagagttgttgcttgggatgggcagaaataaatactatacttcttagatgtgcataatagaggattgctaccccacccttgtgaatggagccatggagtgaggttttggctgagttgagctaccctttagactcccaggtcaagcatatttaacccctacacttctatgaaatacacagaggtggtgtctgctacctgggtggggtcactggcataacctctgaagctgggcttacagactggccatctggaaactcaagctaggttgaacttcccaacatgcttctgaaagtgaccagctcagttttgcagatgggctatgcagttggctggtatctctgaatgggtgccatagctggcagaaacacagaagcactaccaaaatccacatgctggtcactgtgagctctgtccttctttgtttctacctgacctcattacttcctgtgttcccggtgaaatgagaccagagtgggcttcctgagaagtgtctttgaatacttgagaatcttgatgtctacccctggttctcttccccgctgtagaaactgtgaccccagggaactcctctctatctggcattgtgctaacctaaaggagtgggaacaatgacatggtcaaagtgagaccattcttcctactcttctaatttgtcttcactcagttctatgaacaatgtaggtgtcctagacttgtttccaagtattggggttttcaaaatagattttctgatctgtggatagcagctagttggactttctgtggagggaggaagatcctgagactttctagtccatcatcttgctttattctgaattttaattgaactacaaaacgaaaatcctcctctttattacctaaatgcatttatacttccaccaggatacatttccatagtgttatatttgccatcatctgttaccatcaaagtttttaattttaatttttgccaaaaatttagaaaaaaaaattttgctgttgttttaatttatattttcttaattacaaggatgaccttatttttgcatgtttattaattgcctttataatctttggctatttgtcttttgagtagtttttttctgactcagttgtatgacactaattctttatctgttgaatatgttgcagatattttctttcacttggtcatttttttaactttgtttatggcatctgtttttttacaaaagttttaacattaattttatgagaaagggaagataactgctacatttttcatttgtatataattcaccaatactaaaattgtagtaaatgtatgttcatcartagcagttattttattttcagtgagtcaagcattttattttgcttagccatttgtcctttaactatgcttatggcttttttttaagaaacattttaatatgaattttatgaggaagggattcagtatgaaaataaatacyatacttctctcattttcatttcatataatttaccaagattaaaatggaagtaaatgtatgttcatgagtagtaattattttattttcaatgcatcaaatactgttcgtcttcacttccttaccctcaattttctaggttttccataaaaatactatctttgtatatgaaatttgaagaaagaacatagcattattatagaattcaggaccttttgtgggtaattttacttatgtatacttatagggctttgttgttggtgttttctccatacaactgttgagtaaggaagttggtggtgggaactaaatagatcatcttgtgataaccgtcttgtgtcagccatcagwwgacagcaactgaatcacaacatcaccaggctcttacaatttgttgtcttatttggcatgcgattctacataaattactgaaaagatcattgaagaagaaattctgaaaatcacaggaaaccagtagcccatttttaagatatttatatattactgttgtattaaaggcggacaacttttcaggaggagtttaggtataaggcatagtcctagcttctgggtcatagagctgtttagaaasatataatgcagaaataattttcatatgtctgatttgcttatttctctaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctcttcttctttgggcttgtttattgctttcaatcatacttctatccctggaagaatcatccttcctaaaaattctcaatttctaagctcaactaattatttctgcttaatgactttgatagatgataatctccaagctttatgacttcccatctctcccattctctaggagacatattaggctctgccatgcaaaacacacaaaatcttctccagatgccctatggctrtggagagcagaatatggtcctctttgctcctaacatctatgtactggattatctaaatgaaacacagcagcttactccagagrtcaagtccaaggccattggctatctcaacactggtgagtgattacttgagtaagggaaaacttgaatgttatttcaactggatttcccagtaggtttcagttacttatgaatattatgatacattagcttagctcactatgatagctgctatgatagttaatttcaaggaaactatccactctccaacctccaataaaatatttaaggctcagaaactcctaatctatgacaacaaaatttaagaaatgtcacaagagaagccaaggtacttttagtaatttctccaccctcagcatgcacattaatccattgtgctgtttcgttaatcttcctttccaggttaccagagacagttgaactacaaacactatgatggctcctacagcacctttggggagcgatatggcaggaaccagggcaacacctggtaaggaaagaacaattttttgagcttctttttgtgtgccagctcttttacatgtattacctcaattatattcacagcaacactatcagatatgtattatcagaccgatggtttgttatactagataaatccaccaagattagcaaggtaatcagaagaaaacctgatatccaaatacatgttatgttaggcttgtttccaraatggatcctattaataatgtaccaaggttttctttctgaaatggctattctttctaaagtagctaccataaccatgagttttaaaatgatattgccagtgaacatatataacttccagataaaccatgttaacttcagcttatattgtcacattctaagtcattcagcttgacttggaatgaattcattaataagaggaaacaattgagaaggaaacagtaatataaaacatttttttaaatccctaaagtaaagcaatattaaaatttactgcatgtaagagctgcatgtgagaagattctgtcatctgcagaaggaaatctctaaagataagagagatttaaagccttactcaagtaactaacaaaaataagtacattcaaattacttgaatgtaaatttgttcaaccattgtggaagacagtatggcgattcttcaaggatctagaaccagaaataccatttgacctagtaatcccattactgggtatatacccaaaggaatataaatcattctactataatgacacatgcacatgtatgtttatygcggcactatttacaataacaaagtcatggaactaacccaaatgctcatcaatgacagactggataaagaaaatgtggtacatatacatcatggaatactatgcagcaataaaaagaaatgaaatcatgtcctttgcagggacatggatgaagctggaagccatcagcctcagcaaactaacacaggaacagaaaaccaaacaccacatttctcactcataagtgggagttaagcaatgagaacacacggacacagggacaggaacaacacacaccagggcctgttgggaggtgtggggtgacgggagggaactaagcggatgggtcaataggtgcaagaaaccaccatggcacaygtatacttatgtaacaaacctgcacrttctgcacatgtatctcggaactaaaataaaattaaatatactwagactccctgtggcaaagagagagttagcaaggaaatactacatctagcagattaatcaggcagactaaagattaatcaaggagataagmtctctaagtacacaagaattttgttagctaactcacatcatatgaagcctgttgctgtgaagtggttataaaaccattttgacaacataaacatcatgattgcttcctccctggtcaggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaaggtgaatcattctggagctagttttgatttgtccattatgatatctgcaaggatgaggataggaagtgataatgtgaaaaattctaagggaaagcctcagaggaaaataaaacctggatggcaccaaaaaagaggggatagaacaaaagttgattgtgatactttgycctatagggatggatatgggtaaggatgaattccatgacacagcagaatagaaagaactaatcaatagcattctcagaagttgaattattcaratctctctctygtattcacagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcrtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacargaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttataaaatctaggatttcttaatcaaatcagaaatcaraagacaagaggcygtgcagatgcttctcaattacgatggggttatatcctgacaaactcattgtaaagtctaaaaaatcttaagtgggaccattgtaagtcagggaccatctctatagtatgctggtaagaagagcattctctggagactagctccaaaatgtgctacctatgtgagcttgggaaagtcattaacttccttgtgtttcagttccttcatcagtaaaatggggataataatagtatttacctcacagagctgttgtaataaatgaattggtacacgtaaaacacttagtagagtacatgtcacatagcaaatcctataaaagtactagttattacaaytaacatatcagttctcaatatatgcccaacccttacctggtacattatataaccttaaacataagaaaataatcatggaagtaactccttgaatgaattctggtattttaagcccatttcataagaccaataatgttgaccaatctactcatattcacacagtacttctacatataccatggtctatatgarcrgttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacarctctctcatagattaagaaatagaaaattaccgacrtgggaaaaataaatcccttgtgtatcactaccacctccagaggcaatcattatcctgaatttgtygttacaattccatggatttccttatatttttgctgcatatgtatccctaactaatatttagaatcttcacrtgtgtttcatcttgagagaaacaagatttttatttctctcttrttcaagaaacaagagaaacatttttgaatatttcagcagcttagttttttgtttgtctgctttttattttctaagttcaacactatgttgatgaagacccctatacmagtatgtgcagagtcagctcattaattttcactgctgcataatatattacagtctataaattagtcataatttacacatcgagtttctcctcatggattttttttatgttttgctaytaaaaamaatgctgcaatgaatactcatgtgcctgttttcttgtgcatctgtgtttctccaaattatgctttgagaagcataatgactgattagtgggctaagcacatcttccccattgctgaatattgccaaagagcagttggcttcccacagcagtgtatwttggttcccattgtttcacatccatgtcagcctttggtatttcaaggattactgtattttttttttcaatttaatgagtacaaactctactatttcatgtgatctgtgatcctcacaagaaactgataaagacacactttataggaaatgtaacaaactccagctatagtctaatataacatcataaataggaaatagccagactcaatgagacaactgctgtgccatttctttctcccaccaacccgactatagcaacgatttgaaaacatagataggcataggcttctgactccagcatcaatatctgccttagctgggctaaaacacaccaaattcagatttacatgaagggaaaagcatctacatacagtacaggggattataatgggcatgcaattctcatttcagcactggcttgggtactttcaccttgaattaaatataaatatgtaggcacttataaatatctttttctcatctttaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcaygaagcagcagaatgcccagggcggtttctcctccacccaggttggtgatttgccaaaaccttttatttcaccttcaggtagcaaaagatttgaatgaaaaagaaacaracacatccaagaagaaaaaaatacagatgwcagtaacttgaaatgaggaaaagttttcagtatccaaggataatggaaataaaagcaaatcaaagtcaaagagrgccaaaaggaaatgctcagaatyccggcaccccatcgctgtgttattatccatctcctatttcccataacaacactgccttcctcaagcagcagtggagcaccagcagaatgaaggagatgtctcctgccattctcctgaaagctctagggtctctttcaaactgttcaaaggaactctactcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaagcgattctagtgcctcagcctcccaagtatctaggattacagtcatgtgcaatcatgcctggctaatttttgtatttttagtagagacgaggttttgccatgttgcccaggctgatctcgaagtcctgagctcaggcaatccatccgccttggcctcacaaagtgctaggattataggtgtgagccactgcgtccagccccctattcacctcttaatacacaaacatttattcatcaggagcataaagaactgtctttattcatccaacctcctaaatctagctatataaccatgtatctgaacaattcattgatatgtacacagcagaaagttttatcttcagagaattyggatgtttgcttatataccctaaaayggaaaaaatgtgacaaaatggcattccatcctatttccattgtattaatcttttatcatatgaatgaaaaaaactaagtaattttgttaaaggttatcattcatttattagaaacatattatttgaaggaggccaagcaggtttaatgttgttgaggatacataccagcagacattcactgggaacaggaaatcatccaataaaaagggaaagccaaataaaaatgtcattaaatccagaagataattataatactcatcttttatttcttttggagaaactgaagcatgactctgctcatkgctgcaaagaaccttgggttctctccaggacactgacctcagcaactgagcaaagtttaatatgggagagagccagactgaactttgcttgagtggtggcagatatgagcatagttgtcaagaaagacatgttagcaaatagctgatgccaataactgattgccattcacatgttttccacattccatgtcccacatatacttacagagagaaaaggatcaattttctgataaataaaataaacatgtagggcatacagtccaaggtagatatgtgaatgttatggttcttcaactatctaaagattataatcaatcttgaaattacagctcctatatttaagtagtgagggaagtaggaaatcaaagtccctcacatgggtctttgaaaaatatctcagccctcaaagccttataatgcccaatgggttctctcactcatctgtctctaacaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaargtgacaggagaaggatgtgtctacctccaggtgagactcttgggcaggtgaggacaggacagatgaggacagcagctgttctctctgagaagtcctaactcagaaaacaatgggacagatcagagaaagggttagggacrtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaatagaaggaagtagtgactccttagttagaattcctactggcaataataaatctcaggttatatatgatataattaatttggggggaagatacacttatatgcatcaatatttaaatagctgcagatctgataaaaaactctctctccacaaacatattattacttggttggagatactattcaggaaaaaagttaggacaaaatacatgtaacaaataactggcacacatcaaaaagaatgagatcatgacctttgcaggaacatggatggagatggaggtcattatccttggcaaactagcacaggaatggaaaaccaaacactgcatgttctcatttgtaagtgggagctaaatgatgagaacatatggacacaaaaaggagaacaacagacaccagagcctacttgagggttaaggatgggaggagggagaagatcagaaaaaaacaacaattcagtgcaaaatttagtacccaagtgataaagtaatctgtacaccaaacccccatgacacgagtttacctatataacaaacctgcatgtgtacgcctgaacctaaaagttaagtatatatatatatwtttttttcatttaatttggtgtatatatatgccaaaaaataaattaagcagtccaaatttcggatgcaaactctrrgggacaagacgctaggtgtttctaagtgttttgttgaaagccagtgtttaagtaaacattataaattattgttgtttttgtaaataatgtagactgaaatttattattcataatatacatcattttgtcagctgaaagaaaataaaagtaaacaaataaataaaataactggcatagattagaggtcacaaacagcctgtgcatcacttgtagagctttcttaaaatgcagatcctcagccgggcgtggtggctcaygcctgtaatctcagcactttgggaggccaaggcgggcagattaccttaggtcgggagttcragaccagcctgaccaacatggagaaaccccgtctgtactaaaaatacaaaattagtcggamgtggtggtgcatgcctgtaatcccagctactcgggaggctgaggcaggagaatcacttgaacccaggaggcggaggttgcggtgagccgaaatcatgccattgcactccagcctgggcaagaagagcgaaaaactccatcaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatayaatcacatgtgtttgtatgaatgctgaccatgtgcagagcactgygctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaaggraacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaratcttsacaaaatgtgtttattatgttgacaagttttttggatacccagtaatayaaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagahcctctttgagtctacgcaagtattcctgcaagacagagaagtcaaactataccaaatctctggatattaaaaaatgaacacagttagtcrtccaataaaaagtatatatcatttacccccatgaacagagctatgtattggcattgacagaggtatatgcrttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcytcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcycctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgtcccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccwctgtactgattaggtttccttgggcactatgctacccagaactaaggsaaagaatactctctgctcatggagacccaaatctgtcttaattttttttctttccaatgtcacagatcttggaaatgcttgaagaccacaaggctgaaaagtgctttgctggagtcctgttytcwgagctccmcagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcaccagaaaagactttttacattaaaatgaagtagaatgaaatacaacattgaacaggtcatattgagaggcaagataattgggacttgacctgaattgggagtgatgtgtcctatgttacaccaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttcttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggccccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagacagatgaagaggagcattactgagcaatggaacagaaggataaggaagatgaagaggaaggagacctgcagttagtagctcatttccacagtaaggatgtcctttccacagcaagtgtgtcccaacgagtgttcagcttctagcagaaaggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggcttcaagccctcaccagcttcagggtgggacttcactggggacccatccccttccacccaggaacctgtctgcctcctgctcccaggctgttcatgccaaggagcgcctgaaagtcagtgtccagctgtcttcagacccctctcagcctccctcccacgcttgttggtgcccaagttccaaagggggccgagacggcagggggctggcgtatcagcactgtcctgagcgtgtgcacgctcggccaggctgtgacagtacccaggctcggcccgaccttgctctgagttcagagtgggtgctaacagtggagagaagccaggcagccggagtaggcaccctggagcctgcagtgggcaggggactttgctgggcctctgagagcacagaaaatgtccacagccgcggcaaggtggctgcagctgcaccctgggagctcctgctccaccagttcggaaggggcggggctcctgcttgtccctggctcacctgctcctgagtgtgcaggtccggtggcgcctccttgcaggctgggctgatgggcgggggcgggggggggggggaggaagggaatgttccaggtcctccctgggcccgggactgtgtccggggcagggatgacgtcgctgcaagttcttcccgtggccccggggctcaggggcagcccaggactctccctcgcccggctcacggccctgcctggggggcgcctccgggagcagatcacgagccctggggctcagccctcaggcgcgtctagctcggcggtcaccccagtgccgggaggaccctgaagacgcgccccaggcggccctactcagagcctcctcccaaggcccaggaatgcggcgctgtcggaggtgtgcgcggtggccacaccgctgtccgggtccccaaagcgggccccgctcccacttctcgccttggccccgaaccctgggtccagccccagcgctttgtgtgcgaacaccgctccgccccggacccagctccgccttggggcccctctctgcctgcccctccgtgcccgactacactgcttcccctccggcgggcgactcagcccggtccatcgtggcggcttccagggcggcaggctccgggagtactcccggggccggctccaaggactgttcccctcctccccactcccactccgcggcggcggcgggcgagagcggcgacatagggccagggtccggagcggtggaggctcctggccggggagcacgtcgccccacccggcaacgcgaggatggtggcggcgcagtcggctgctttggggtctcaaggcacaggggacgcgaggcacagatgtcccacagcagccactgcggctcccgcagctgctccgccgccgctgcccgcccctccctgctgcagctggcgtgatggcagcggcagctctggacgccccactgctgccaccatcagccttgtgaaataggtactaccttaacaaatgaaattgaagcagagacatgtaatttgcccaaagttactaagttagtgacaaagctagaattcaagaccaagaagtctagcttccatgctcttaacttccaaccatggtgacacctcaaacaacttcagacaaaaaggccaggagaaagtatatttcagagcttaataaacattataattagctgtcaaattaagtatcaagccagggcacagaacataaaagaaatcagagtatggctatgggaacaagacaacaggattataattttacctcttggttctagtttttttctttgttcatatggaaatcgttactgaaaaggtactttaaggatatgcttgttgcaaatcattagctgtatcactgaccaagagtgtttattcctgaaatactaactgattgcctactatctgccaggcacaatatcccatgctataatacaaaattaaacaaaataggattcctcccttagaaaaactcaccgcagagtaaaagaaaaagatacacatctgggtcattataatgatcaggtgctcaagctattcattgccccagtggactggagatacaatggccttctcaagttttggggtattacactcaaattcatatgtaatactggagaaaaggcctaattacaactaaaactggatttcccaccagcctggtggcatgggaatcttggaattaaaattacgtagaatttttaaaagtgatgtatcttctacatctgattttgtgaactgaagtttattctttccaggaaagcatatagatacacgacaggaaatgaaatggatacttgttggggtcagttttatgtatagtttgtattttattttgaaatatgatacactgctattctcttgcattttcttatatgtgactcaccactaaccctatattcccccatttcaggccagttggtcataagcatccatttgcctcagagaatactgggttgttatgacaagaatataaagttggaaagaaatagaatatttgagtctaccctgtaagaataaaaagaataaaaggggtttaaatttatttagaccctattgtttaatcaagaattctggccaggagcagtggttcatgcctataatcccaatgctttaggaggccaaggcaggaggatcatttgaggccaagagtttgagaccagcctgggcaaattattgctcgggaaaaaaaggtcttatttagtattttagtctttacaatgtttttttctattatgcaatattctctcaaatactttatgtccatccacgttgtctgagacatgccactttaacattctagttatgctgtagctgtcattttaccctaagccgttagtagtactgatccacataaaattgggctgtttaggtgtttaactgtttaaatgtataatatatctgatatatttatatattgtataaaaaatcacctaacacaatagatatttactatgtctgctataaatatatatcatataacatataacaatatattataaatgataatatactataatataaaatataataaatatattataaatgtacaatatatccgatataaatatataaatatgtcaactatattatacatataaatgtatatgtataatatatacatatatgtataatacaatgtatttattatgtatatatataaatgtatatgtataatatataaatgtataatatatctgatataaacatatcagatatattatccatctattgtgtcaggtgattctttatacaatatataaatatatcagatatattatccatctattgtgtcaggtgattttttatacaatatataaatatatcagatacattatccatctattgtgtcaggtgattttttatacaatatataaatatatcagatatattatccatctattgtgtcaggtgattttttatacaatatataaatatatcagatatattacatatctattgtgtcaggtgatttcttatacgatatataaatatatcagatatattatccatctattgtgtcaggtgattttttatacactatataaatatatcagatatactatacagttcagcccatcaaagcaccatattttggggggttggtttccgtgtcccaacactagctacgaaaatattagctattagctacctataactcttcagtagtaaattcaagaaacgtaaagtaattctcttcattaagttcttgccttgtctactaaaaaaatggtcatcaccgatgtggacaatgaagacctgtggggttaaaagctctaactagtatgcctccaagattctttgattgcctgccatcatgatcgaagaataaataacttctttttcatcttatttatttattttttgtagagatagggtctcgctatgctgcccaggctggtctcaaactcctgggctcaagagatccttctacttaagcctctcaaagtgctggaattacaggggtgagtcaccacgactgaccattaataatttctttcaatgacactttaacataggctcattcatctttacctctaa

SEQ ID NO: 17714 - DNA, 45038 bp, Homo sapiens
gaaagtatgtcataatcctattttaaagacttcacatgatctctatcacctactctgcccttaggtcattgatgacctgctatatttattttcttctattgcataacaaaatacaagaaatttattgacataaaacattagccttttattatctcacagttacaaggagtcaggaatccaggcatagtgtggctggggtctctgctcagagtcttacagactgaaatccgggtgtttgctgggctgaattccttctggagcttggggttgtgggcagaaaccagttccttgtagctgtagaaatgacatcctattttgtctttgctggttggtgagagtcactcttagcctttgaagggggccatgcggctaggacctgaggtaagtagttcataacaaggccatttgcttctttggggccagctgtgaattactagacagtctgctcagatggagtctcatataacagcacctaatcaagggagcagtgatcccattatagtcacagatcccacccacaaaaatggagaggggtgccaaagatgggaatctcgagggccatctcagaatcaggtctgcaaacctgcaacttgtcgcatccagtcgggaaacttcacttcttttggtatttgactctagaacagttggcaccattgrccactcccaccttgaaattcattcaatgactcctatttatttattatttttattttttatttttggctctcactatgttgcccaggatggagtgaagtggctatttctaggtgtgatcattgcacactacaatcttgagctcctgggctcaagcatgggacactgagcccagcccagcttatccattctacttttgatgaccatttgagggatctctagtttggtgatttgtattagttatcttgctgtgtgacaaatcatgccaaaacacagtggattaaaacaccatgtattacgtgacagtttctgtagattgagactccaggcatggactcttggctaggtcctctggctctggtctctcacaagactgtaatcaaggtgttagctggggctatggtctcatcttaaggcttgagctggggatgattcgatgctgaattcgcttaagtggttgttggcaagaaccattttatcacaggctgttagactgatggcttcagttcctcaccagctgttggcaagaggcttcccttgagtccttgccatatgggtccttccatagggcagctgacaatatgacagccagcttcatgagagcaagcacgcaagagggccagagagagagtgtgagcaaggcagaagtcacatccttttgtaatctaatctcagaagtgatatcccatcaattttgtcatgctctatttgttagaagaagttgctgggtccagttcacacttaaggagagaagattacagaaaggcatgaatatcaggaggcagaaatcttagggagccatcatagaagctgtctagtacaaaggatataacaaacaatgctgccttacagattttcgtatatatattgtggcatatgagcatatcaggttatgcacctaggcatggagttcctaggtcttagggcatgtgaatcttcaagtttccatgacagtgccaaacttctaccaagtggttataccaattcacatttccactagcaacaagtgagaattctgtttgctccatatcatcgccaacactttttattatcagacattttatttttggccaatatgatttatataatatgtgatgtattatagctttaatttgcatttctaagatttctaatgaggtttggtactttttcatttatttattggtcatcttatatttcctcttttatgaagtatctgcctgtatcttttgtccatttttctactgacttttcttactgatttgtatgagttctgaagataatctggatgcttgggctgtggcagttatatgtgttgcaagcatctctctggttttgtttcctatctttttattcttttaaatatgtcttttgatgaacacaaggtcttcattttaaggcagttgaatttatcaatcttttcctttatgaactcttggactaagcctgtcttctagctattgttttccgcctatgtctccaactgtccccccatctttgatccccccattgtctccatataaacatcttttctatgctctggacacatgacttcaactgctcactcgatggctccacctccatatcccacagtcagtccaacaccagtttatcccaaaatgaactcatccctccaagttcaccttccgccaccctaccacccctagcttgtatttcctaactccatgactgacacaactatccaccaatcacaaagccagtgtcttgtgaatttgccctgactgctctttctcttataaggatccagtttttctgattctacaatctaaaccttgccccactctgtcttctcctctacatctccagtgccagaatgtaagttccatgagaccagggaccttgtccagcttgttcattaccacaatatcagtaagggatggtgcttaacagcatgaattttgcagcccaattacctgattcaaatcctgactccatcaattattaggtatctaagtaagtggaagttatatgacctcttctcccgcagtttccccattggtaaaatgggggatgataatagtactgattcatagggttgtggtgagggttgaatcagttaatgcatgtatagtatttagaaaagaacaggacacatggtaagcactcaataaatattgactattaatattataccctaccacctagcatgggatggggtataatattatgcatcaaaatatattttaagcatcaacaaatatttatcatcaaaaaactaaccatcaaataatatatatcaacagagatgaatgaatgccactgctttaatttagactcttattatcgttgcttagacaattgctgtagcctcctaactgggcttactttctgctaaccatcccatcccccattccattcattttacacactgccattagggttataacttcttgtctataaatatgaaggtgtggtgccactccattgcttaacaccatccagtggatccccaagccctacagggaggcagagcatagcccagactcctcagcagaacacatgtgcatgaacgtgggatctggtgattgcctacctacctcttcaaccgcctccatccttcacacaacctgcgctccatttaccaaaccactggcagttccccaaatgagccacattccttcattcgtctcctgcccagaatgccctccctctgtcccgtccaggtgacaaagtcatctttttctttttcaccaagtcccagatataggcactcccaggcagagttagatacctatattattgcagcatttatcaaattacactataaccatttatttacatgtccaaccctactcccccaggctgcaagctcctgagagccagatcgtatttagatttgtatttctggcaagaagcacaagggctacggaagcttaatacacatttgttgaatggatggttagttttaagaagtacctaataaaccttggtatttgtatttccttgaatcttgttttggttgctaccttttttaatggaaatagtcactactgcttatgtttacaagtttattgagttctaattttatcttttaagataaagattgctgatatcattcattcactcattcattcatcaataaatatttatagggagacacttgtcagatactggatttgaagtgaacaaatcagacatggcccctaccctcgtgaggcttacagtctattaaatctattaagtatgaaggacaggctgaccttgaaccaataaacatgtccatgtaaaatcataaattgaaatgagagttgtgaaggaaaagaataggttataaagaggaagaataatgggagggacctaatttaattagaagagttagggaagttctctttgaagaagttacattacagggaacactaaaatgtgggtaggagtgagctacgcaaagtcatggagaaagagtattccaggtagaagaaatagcatgcgtgaagaccttaagcaagtggaaggcagctgctgaggctggggactgggaggttggggctggaagcagacaagcctagagaagttgtcaggggctagacgatggggttttgacctagaatataaactttgtttgtagttcatagggaagacattgaaggtttaatatatgggaatgacgggaacctctggcagggctctgcctgtgagcatcacatagcaccccgaggatgtgtttgctactctaggtttcagtggagaaaaaagcaagtgacaacccttctgttcctgctcagcaaaagctttgatcaccagcccccttcccctgaatatactggagaaaaataacagaagtgcatttcaaggtccacatgtgagaagaccctaagctgtcctggctgttcaggtagaagttgtcatcttcctcaatgatctcggctgttggaagacatggccaggcagacagaatctaaaagttcttccaggtgtgacatgagtccctggagctcagtgacagaaaccagtgtccaaaaccagatgccaccctggggagggggctttgggagttcctgggaggccataacaccgtctggaaggctcctctctcccacatattcacaaagttgcatgataagccaggcccctgctggtcttgcagcatccacctatgatgcagagtaaacagtgccacacgtcaagctgtccccaaccttgccctcggttccactaccaaaagagggaacactgggcttgccccagcaaggtgttatttatgtcaggctagggccactgtggctcccagctcttactgctttctaggtgcccttacagacttccccactgccccctgcatatgccagagtgtgaacatcccctccctctccacagcccccacagtggggttcgggtgggcagggaggtggtttcatccctctacatacagcccttggagacctacctaggcaatttgtcactcaggcttcaagctgccagccgaggaggggagctgagaagactctataatgagatctttgcactgtwattaagtgccaggctttgttttacacctatctttcccgccttgcccgatcccaccgccaagctcctccaggcagtgagtggggagtgtcagctgctctgtgattacaccccaagtggcaggtggcagggagctcctccgcctgcagtctgcgccccacccccaggcttcccccaccaccagtcttaactcaagacagtgctatttctgtccttgaactgggtttcaccccagaaagccactccaccgctttctcataaggctacctccttttaaccctgtggttgcacggcctctggggtgtccatttctttcttttgacacgtcccttttcctgaaagtttcagcaaaccccataggcagagggagttagaaaaaggaaaagagaagttagggcaggaggagcactgttcttataggacaggaagggtctgtcttctctcttgggtcctccacacaaaatcggagcttccaaacaccccagctcccaaacatatgcagcagattctgctgacaggaatgtgtcactgtgatcttcacattttagcctgaagtttagcctacctgaagaagcaccggagtgggagtgggagaacatgggatggtgcttctctttggcctggctgtgcttttggacacttcaggtcttcggcctgggtttcctcctccgtacgatgaggagaggatgggagggggcaatgctggcatgtgtgatctcgatagacactgtggaagtctgcagagaccggagcataacctctgcctcctctccccgggcctagcctctcacagccctcagagaaaaccctgagctgcggcgtggccgagacgggggcgtggcctggcaggtgggcgggcccttccgtgggcggggccgcgaggttttcaggakcccgagcgagggcgccgcttttgcgtccgggaggagccaaccgtggcgcaggcggcgcggggaggcgtcccagaggtgagcgccctgcagcggcaggggatgggccgggggccctaagtcgtaggcagcgcggggcggggacgcggctgcctgcggaggtcggactcctctccgccctcctcccgggctgtccgggtctattttccagtctatgtccaactcgcgccgcctcactaggcggcgctctctgccccgcggcacccgcgagacgtggggtccctcggcccagggacggggtgagcgtgtcatgtgggtgccctgtgcccggcaggttggagacgaagagacctcggcacagacgaagtcactcacatcctcgctttgaaacagagcgggtccttcttgtgctgtctcgctgtcactctcgcccccaccctgtggaagaggcaggtggcttgtccccagtcactttcttccttggaaaagggagacagagggccatctccagcagggccatggaaatcccagaaagtcactgagctgctcaacaaaaggccctaaacaccccaccccacagcaccaggcagtgcacactggccaagactccgtggtaaatattgctggcctttatgttgagagggggaaaaaaaagcctgcctgtgaagatcatygcccagtggccatgctcctgtgaaaacacaattggaaagccatttcctaaggggcgagggtgggtctgggaccatgctgtggcttgggtgattggtggttgcaggagtgagggtgctgccctgggaaggcgctgaggccctgttgggtgggaatcgayggctgcggctttctcccggaggagggagagcggtgttgttacctagtgttgggaacacatccgtccagcaccgtgaactgcaaacaagcagagtaaccctagtgtccttcagatactgttgctgagcagtcacctagtcaatgagatgatctgtttggacggcaagtgcatctgtaatgccgccctcttgctcagtgcctggaagaggcattggtgactccccgctaatgctaggggtagctaccgtgcaggagcagtcaggctcttgcagggccwatgtggtttcatcaattttctcctgcatttacccagcccctccgaattctgagaagtgcgtccaagatctcttggactccttgactcagttcacccttgttcttgtgggcagaaaacaattcccagtgtgccatgcacagccagtcagaagggaagccctggagcagggccctgggagaagttctgtggggctggatgctaattattcagttactggattgtggggaaattccaggggaggtcccagaggagagaccgtgctaaagctaattactaagcagtacaaaaataatctctctctctctctttctctctctctctctctctctctctctctmtmtatatatatatatatatatatatatgtaattttttttttgagacagtctcactctgccgcccaggctggactgcagtgacacaatctcggctgactgcaaccactgcctccagggttcaagcgattctcttgcctcagcctcccaagtagctgggattacaggtacccaccactacgcctgtctaatttttgtatttttagtagaaatggggtttcaccatgttggtcgggctgatctcaaactcctgacctcaggtgatccgcctgtcttggcctcccacagtgctggcattacaggtgtgagccactgtgctgggccaaaaataatctaaatttcaacaatcagcatgaccatgcctgtgcgtatgaccctaattatcagtctgactgattcttccttccaaaatgatggcagaggatcacctctttggatatttacagctctgagcaaagcaaaaagcatgtaggtgccattgtctgaatgcaaaaccagccatgccaggttttcggtgttgtttctgaggagggagcgcctctctggaggacggtgtttccagaacagtgcctccgttgttcattcccgtgcatcaggaagtttggctctgctgagtgttgaaagcaaaactctcctgtttatttgtctstgtatactracagacttaaacagcagacagcactggaatgtccagttactgcatccagatgtgtttgtttcactcttaacattgtggaaaagaatgcagaaggcagatccaaagcttcaatcagatttctgaagcttaagtgattcccagccttggtcccttaatgtgagagcaacagcgtatagtgtcttccgctctctgggacaaacccaagtttgaggcatagtccctgctgtccaaaagctcctaggtctaagtaggaagacaaaaccagcacctgtgaaacaattagagcgcaattaagtgcgaaagtatgtggcagcatctgctagctcaaagaagacagctagtgcagactgactgggaaaggaagagagagcttcacagagccagctggtgttcagcttgacttaagaatgaccatcaagggcttggccaggcctaggaaaggaagcatgaggatatatgaagctcagaataatgaaaggcacttgctgcccagagccaattcaaattcctgccttccgggaattctggctgtgggtcctgccactctcttcctcacccagccatgatgcccttcttatagcattctaaccatgccttttttttttttttttgagacagagtctcactctgtcacctaggctggagtgcatttgtgtgatcttggctcactgcaacctctgcctcctgggtttaagtaattctcctgcctcagcctcccaagtagctgagactacagtcacgtaccaccatgctcagctaatttttgtatttttagcagagatgggatttcaccatgttggccaggctggtctcgaactcctgacctcaggtgatccacctgccttggcctcccaaagtgctaggattacaggcgtgagccaccacacccagcctgaccatgcgttttttgtgtgcctcctttactttatgcctactctcctatgctcaaaatgctctgctgaccaatcccctacattttttaagaagcagctcaaatggcaccttctccagtgaagacttccctggcaggcccctacccgagtgtttgagcagagttggagggtttctcctttgttctccattggtccttgcatagacctctgttgaagctccgtattgtccataggagttaagggatctttgactcactcactgaagcagagctgtgtctcacttacatagggctcccctgagcygaatttggtgtctggcacataagaggcgtttgataaatgattcttgattgaaattcaagcccttataggtaacagtgaagtgccccaccaacttggagtagaaggcacaggttatgtgttacaaggagtctcagattggataaattagatggagccaattcctagaggccttgaggagtctgagtgtaatgcagtggtggtgctcaaaactcagagcaccccctattgccttcactatagaattctagagtcttcttgatctgcccccagcatatcctctttagcctcatcttccaccagctcccaccttgagcccacaaatctaccttctgagccactgcagccccaggtagctccccaggcctaggctctctcttctcctttgtccatgctrtttggcagccttggccaggaatgcctactgctctccctagctaattcctgatcattaatactccagatctgaatcccctatgtgcagaggcccctcargctgggttttcaaattctcctctgtgctccatagcaccctgcacakcctctaayagcatttatcacaccctcttatggctgctggttacttggccatctccctgctgggatggctccctgaaggcagtgattgagttaatccttgatgtatcccccatcagctaacattgttcctaggagatggtgtccaataagcattggatggtaggctgaaccagagtgataaaaatatcaaacgaaggacaaatctagagacatctggaaggggaaaactagaatttggtgatgagttatataaagagagtgtattagtctgttatcacactgctaataaagatatacctgagtctgagtaatttataaaggaaagaagtttaattgactcacagttccacatggttggggaggcctcacaatcattgtggaaggcaagggggagcaaagtcacatcttacatggcggcagccaagagagcatgtgcaggggaactcccatttataaaaccattaaatctcgtgagacttattccttatcacaagaacagcacgcagaagacctgcccccaggattcagttacctcccactgggttcctccctcaacacgtggggattatgggagctacaattcaagatgagatttgggtggggacacagccaaaccatatcaaagagtaagggacaaggttttttcaaacctatgaggcaggtggagatggtgtgctrcagctgtaggattccctggcctggggagaagtccacttatatgtctcygagtactacgcaaaaatttttttgtttcctggaggattttcaaaattcaaaatatcaagtcactttgagacatattgagtctgatgttaaaaaggaaatgwtctagagtcaactgaaacacacactttaagtacaagtgaggtcaggcctagagaaagattttgggagcatagtggcracagtttaacttgtgaargcaaatgtggtcactgatggaagaagcctgaagcagagaacaaggtcttggggaaacctrgaagccatgggggtgggaaaaagaaaagtatctgttggaaaatagaatgmtagaaagatagggaaaaaactaaggaagccaaaggaagagatatttcaagaagaaataggtggccaaagctgcccaatgctaaacaaaacaaaacaaaacaaaacaaaacccacaaggagattcataraagaaagaggctgggtacagtagttcatgcctgtaataccttgggaggccaaggtaggaggattgtttgaaaccaatagttcaagaycagtctgggcaacatagtgagacccctccacccccacccccacacacaaaaattatctgggcatggtggyacatgcctatagccccagctactccagaagctgaggtgggatgatcacttgaaccccggagttcaaggctgcagtgagctctgatcgcaccacttcactccagtctgggtgatacagtgagacctggtctcaaaaaaaaaaaaaaaaaaaaaaaaaaaaaaatttaaaaagccagacctgaggaggttaaagagaggctagttactgagttactgggcaatggaaacattgggtggggtttttagactttttgtctgaggaatttggccataaaagaaagaaggaaggaggggtctgctcaagagaagactttctgtttgttttatggtaagagagatctgcctccctttgaccacactagggaaggagctcatttatgctaaaggaatatggataaatattcatattgttcacttggttatatttcatttaaaccttcctctcctcctttcctgtcctctgcaagtgccccatagaactttccttctggggaattgccaaagtcatggtattgctaaatccagtgacagggtgttgcaacacagaaatcattggttctcacttcactggcctgtaatgagactccctcaaatgcttccaaacaactttccttcctaatagtgctagtcaggcattttctcttttactgtgcacaaattaataacacagtaaaagcagcaataatagcaaatgcatagatagcagttactctgagctacagactattgtgagtacctttgaggggtaagtggtgaaccagtattcaagcttagcatatttgtcttcagggtccatgtacttaaaccactatgctaaattcaagataagtaagtttgtattttaccatagattgatgttcatgttcctgacactactacaagattcatactcctgatgctactgacaacgtggcttctccacagtcaccaaaccaggtatctctctggacccaggttcactgtgggttggactagctttaatagtcaataaggccagggacaatggcacacgcctgtaattccagcactttgggatgctgaggcgggcacatctcttgatcccaggagttcgagaccagcctgggcaacatggcgagacccacttctacaaaaaatagaaagattagctgggcatggtagcatgtgcctgtagccccagctacttgggaagctgaggtgggaggatcacctgagccgggggagttcaaggttgtgccatgatcatgtcactgcactctagcctgggtgacagagtgagactctgtctcaaaaaaaaaaatttaaaaaacagtcaataaataatttgatagtcaacaagcaatctgccacatgcaaagtattgcaagggaccaaaaaatataagctatatgtcccatctcatttactcttcataaccatcccattttayagtcagggaaactgtctggatttgaactcagaagaccatgataaaggcaaaatcagaagtcacttttagtcctgagtttctggggtctgagattcctcctcatcttggtcagagatataactgggttcagatagcttcaagactaccttttcttttatttcccaacctgtgaaccaaaagggtagtgagtgtgaatctctagcatgcacagatgtgcaagaaatactgcctctcctctattttctagatattaatattagtttagagccttcatctcatctggccagcaaccatagaaatcaccccaggttgtgtcactgtgtcacaatttcagatctcttatgcattgccaagatcccaggggctcgggtgcaggtatctcctgctcccccatctggtccactcgggttaccactgaaggcactcttgtgcctgtcttgcctagcaagtcctcactgcttccagaccacatagctaactcactggggtcctgccagagtcctgtcttcctggtgctgacagaccccttttcccttcctgtcttcctgtttctagaagcatgtctctctgctttacccatcagcacaccccacccctcttcccccaacttggcaaagactttgtgtccccaacctaaggccctgtttggaaaatcaaagccagaagaacttgcaggctattcctggtagggttctgacatatacctgccctggaccaatgactagggagctggctacagaggtggaggtgagcctaggaaagcagaaatacaaggagagggggaaaaaaaagtcaaatctcaaaatatctagccgcagacataagctcctctgasggtaatttcttgaggggggaaaaagttgctatttaaagctaggatatatgtggttccatttttttcatcggtacattaataacatcattttccactatgtatcttcaagatccggtgtaacagccttgcaaatttgccagaatgaagaaggaatgttctgcttcagggaggattggccctggtctatgattgctgtcatgatgatactcagcaagtttccttagataacttcagagttaacaaggatktaaaaatgcttccatttcaaactcaccgttatacatatgcagaaactgaggacaatgaaagttagagttgtctaggatacccagactgtggctgaaggaggactagaaccgatatttatcctctcccagcccagcatttttgccatggtctcatgtatctcgaaagtaaccaccactagcaagttggagccaaatcaactagctgactccctgccctgactcagaatggagcatagccaccctgggcagcctgcccaggcagattccacatgcagtaaacctccttcgggtcccaggacactgggcacagggtggggacctgtgcttccagcaggggtgcgctccccagcctcacctgtccctgcttacagtccctcaggcaacaccagtgaaatcatcttcctctcagggcatcctcatcctggcctgagtgccccccacctttccttctcaacctcttcagggcttaccttgcatcagggggtgtctccagcagctgcagggtgcattggattttatctgcctgggaagctttctcttgattcctttgctagcccagcacagactacacatccctctcagaacagttctcaagtgtttgatactctctcttcacattcccatttcgtatctaactgatcaggttaatagggttcctagttgccggtcaccacccccaccccagctgtttccaatttacatcacactccaaatgatttttgcagcgcttagcagattgtctgtgtcattactttcagggatgctatactggacttccctactctcatctgctccagccccctgaccttatagttgcccagctttcctggcaattgactttgcccatcaatacacaggatttagcatccagggaagatgtcggagcctcagatgttaattttctaattgagaatgttggcgctgtccgaacctggagacaggtagggatgttcactttctgggcgagccaccttttcccgacgattttaaatgttgtgctagttgttcgtttttaataatcactaaaaattatttctttcaatcagatgctttaaaattgtgtgctaaagagttataatgtgcaaacaacggggaagccattctgtacctaaaccatgtgttttcaacataacttttcagagtatcagcgcctttgcttgctgctgtttttgctgttttttgatgctgggaaccaccacctaaagatagtaaagaaaacacaggaagctttccggtaactcatgctaaagaaacacaaaatcaccccagtgccttgagaaatttcctttccctctctaactttccccttcagtgttctaaagggaaggcgtttctggtaaggtgtagttgcgtaaatgatggctgcctacttcagcaagcaagaactgttggagtattaagcatgggtaactggatattctggtttgggcactggaggatccctggaagccggaagcaggctgttgctgccggggtaggggcggcgggggtgggaggtagaaacttattgctgtgattttataggcagtaaactgatgcttagagaggttcagcactcgcccaagctcacacacctactaaactgtggagctaggatttgaatccagctacaaatttagttgtcattgaaatgtctaaatgcactctactgcgcaagcgataggaacttcccagcggagctcagctcagggacgcttgcagctccccgcgccccgctcgactctccggccgcggctccgcgggctcctccccctcggtccctgccccttttgcgccctctgctggtctctagggaaagcgcatctcctgaaatcagaagtcgcacccaagctgtccygtttccttagctcctagtaaagcgatatgacccatccatcccctcctcctcaaagcctcacatgaatcttctttgaggtactctctgatgcttcactcttcagcgctgagaaaaatggggaggaaggggaagtgaatgtattagtatagccccttctcaaaaccaatcgtgcagcatcttagccatgccttatcctggaagaacgaggcagctcacgtgggcatgggggtaatgagcagggaggcaattacagactcttaggttctcaccgctaacagtgtggtcagtggaccagcagcagcatcacgtgggagcccgttagaaatgcagactctcaggtccttcagccacagccctgatgaatcagaatcaccgtttcaaggaggtctcaggcgggccgtttcaggttccgagctcgctttgaggctctgtggatgttttgcagcatattcaattttgttttgttcaaaggtcacagtgacaactaagtttgcagcgggattcaaatccgagctccacagtgtaataaatgtgagatcttagayaagtgcttaacctctctgagttaatcatctatcaaataatgaaaagcactataagccaactcttcaactttcaggacattgttcacccgaaacccgaaatccaataactgtgcactgtcttctaacacagccataatttacctagatgtacygcttagaaatgtctcactctcatrgtgaccttagttctatctgtccctagagagccgcaagaccattttgtctggargttctctgctcactggacaatagggacagtggaattgtcctcatccttgtgcttgagtctttggaaaccaaatgaccccagaaatgtcatgaaagagatttttaggtcccagaggaactgaatggcttagacacccaccttctgaacaagaggctgggccagagatttctcaaggtcccaacttcaaccttggtgttctgtccgccttgatttacaaaatggtcttgatcttttccaattaaaattcyatttagtagagatacacagaaagtttgcaattcttccacaagaaaactgctgtatggcatagaaaaatatctacataatattttttgtttcttcttcttaattagctttcctattttcccttaggaaaacaaaaagtcctttctcctgattcaccaaaaaataaaatactgactaccatcactgtgatgwgattcctatagtctcaggaactgaagtctttaaacaaccagggaccctctgcccctagaataagaacatactagaagtcccttctgctaggacaacgaggtaagtgcttctggtaaaaatgtgtcatagtgtgtstgtgtctgtgtgtgtatgatacrtatataaatatatgcatatttgtacatatatatatacatatgtacaaatatacatacatataaggtctctctgtcgcccaggctgaaataaagcagtgtgatcatagctcactgcagcctcaaactcttaggcttaaygatcctcctgcctcagcctcccaaatagctcagactacaggtgcacaccagcatgcctggctaatttttctgttttttgtagagacaaggtctcactatgtggcccagggtggtatagaactcctgggctcaagcagtcctcccatcttggcctcccaaagtgctgggattacaggcatgagccaccatgcccagtcctgtcttcaaaakattaatggagaaaaatattgctggggtacttaagttgtgccaggtactacagggggatcctgcatgaatgaaactgagtgcctgcccctcaagacttacaatctagtggagaaggcataatataataaaaatgccatgatggaaatgtacccagaataccaggggacggagataaagagtgcatataggccaggcatggtggctcatgcctggaatcccaacactttgggaggccgaggcaggtggatcgctggatcccaggagttygagaccagtctgggcaacatggtggaaccctgtctctacaaaacaaaaacaacaacaacaacaacaaaaattagctgggcatggtggtacaagcctgtagtcccaactacttgggaagctgagatgggagcatcacttgagcccaggagattgtggctgcagtaagccctgattgcaccactgcactctagcctgggtaacagagcgagatcttgccgcaaaacaaaaaaacaaaaacaaactagtgcacatagaagtgtgagaagtgcatgtagaattctcatggcagaggtggcttctgaggtggcctttgacgggggagttggaatgggatgagcagatgagacattcacgagcattccaagccccaggaccagcctaagctgagagaatggggatgagggcagactctgagaatggcaagttagatctcgagcacaaggcagtgatgggatgccagtgtagatacagccaggaaggcagggtggctggagtttcctgctctgtgaaatgaaagggttcaagccctgagggcctctctagtcaaccattccagaattcacttagagtctgtggtggggaccctgaggtcatcctgaagagtttgagtgatatgagcatgaggagtcagtgaagacttctaatcagagtcatgccctaggaagccccctcagatagtaagtgaggggtgtgtgtgtcagggtcaggcttactatgggagactagcaaggtggtgtctcccatatctagaggggaggcagtggagccttgcagccaagcagtggctgcagaattggaagaaggggaatggatgctggaggcatcctgacgtgaaattcacagaactggccaccaacagcattgatgccctgcttaaagcttcttccagctgggaattaaggaaaccagaatgacctcaccctcctggttagattttaaggatatatacactaaagacagaaataaggatccatgagcaaagatgaatatcaggcagtgtctgaccagtgagaaaggtctcagaatggctatagccctaaatgctctgaatttgggggaaatgctacaaagatgcaaaatgatttttcaagctctgttcagataaggaagaaggaagcaacaagctcactctcagaagcagatggtgcaatggtataatactagcagataaccactccctggcaggagagaagtgatggcccaggtaggagagaaagaagcaagcaagtgacgtggggctgttctgaatctgcccaagtccttctcagaccggcccatccaaggaacccagagaactggcagaggagccctctgcacctggcagccttttctgcagggccacgaagagggagggaggcaccaggcaggatgtgagcaaattcattcattcagcagatatttgccaacataatacattctaggtgctggcaacacagtgagtcaaagagaaccaaacaatacctggcctctggaacaaaattctgattcacaaaaagggacacaggtgggcttttaaaccacaaaccagcgagcttgacaacaactgtggacaaatttctagaagaggtttagtaggtggtctgcagctctgtggaacggtgcggggatccctgtatgtcagcttgtgtttctgaatggccagtcacagagaactcagcttgtttccatcctgacagggttacccttttctagcaactctaggaatttggcagggcatttgatagtctctcagggtacgccccagcccccacccattgctaatggaataaagactgcacataaaagtgcacataaaagggaaatttaggctacacttaatagacgtgctttgtattatggaatcataaagacctagagaggcaaacagaccctaatgagaccaccgggcatcagtaaataaatcaaccgttctgcagtgcacagaaacctcgtgtgctgattctctgagtcctctttagagaacagtagttagttgtcagacgtttagcccgctgtgttaatccctgatgctaatgactgttgctgctcaggcgtgtgatggctctgaggagaaacctgggtaggagctcgctttccattttgcccgcatgaacggactgcctgttcctggccgtggagtgcattttgcactcacgtttgcacgagtgagctgccctccctccctgaccttgttggcctgagtgtgactgcctggggcccagtcacacctccctgaccccagtttcctctcccagtggcgctgctgggtgctgttccccgggactgcggcagagccctcctcgcgggccygacacggtgtccggccgcacggatgaccggtagagggcagcagcgcgctccgggtcggtcgggagcagggccttcctagtccagaaaccgcggcaggtccgctgctgagggccagggcctggtgggctaggggcaagagcaacgtggtgaaccggtgggctcactctgcaggaagaagagaaagaggagacgtggagaagtcgtgctgaccacatggcgtatcggacactgcacatttatgtgggccccaatgtgcctggcgcatggtttctgcgacaggagcccagccgtcaggtgtagacgtgcaggaggctggcagatgggctagaaaagcaaggaggctcagcacttggaggtgtcgaaagagggtttgaagagaaagcccggagtgcctggaatggtggggaggcatgaagaggctgacaccatgaaaggcaaggacagttcaagggcactttcaaggccttcagggaatggtgcagagaagtgagcgcgcgcaacagctggagagggcggttgtgaggaaggtcggagagaaggccctcctgtcactggcagagggtcttgactgcaagttgtccaggttcttggcgttttgaacaaagaattggacaaaatacccagcaaagcaaaaagcaaccaatcggaggctaggaagaagctacagttatattcctatgcaaatgaagactcgacaggccatcagtctgatgggttgtggacagcagtcattcagaggctggagtgaacttacaaagttgcaaatgaagactcacctgcagtcagtctgattggttgcggacagccaatttcccatctgccacacagaaaaggacaaagggagtagcgtctggtccttttgttacttatgcatggaaagttaggattttcctttcaatttagttctgggaagtcggtgtgaaacagacttaggttccctgcctccagaccctattctactgcctcactcccacattgttccattgtcaggaataaacgactctgggggtaaggtggacctccagatgacgacgaaggtagaaggggaggagaggctgagaggctaacctgccactgggacccagggccaaggccctttgtgattgaggggaagtgaccacagatcagcagatgatgactgagagatgggctggagcaggaccgtggtccggtcctgaacaacacatgcagccatgcccagagatgctaggcttagaggctaacatgcagtagacagctgcgtggccttaagttacttaacatctccgggcttcagtttcctcatccgtaaaatggtacctacagtaatggtacccagtaatagtacctacaaaagactgggaggatgagggaagggagggagctcccagctgtgtggggaggagcatacrggcgagggtaaccccccatatggtattatagggatttgcgtctatttctgtcctccctccagactctagcctcatggttctcagacatgggtatgcatcagaatgacccagatgcattaaaaacactgccaggtcccagccccagagcttctgattcagcggggctggggtaaggcccagtaatttgcattgctcgctaagcccaggtgctgctgctgctgcttgttcccggactgcactgtgggcaccactgctctggagtctgcagagctccagcagggactcctgttgaggagagacgggcatatagtgggagcccaggcctaggacgagtaactctaggacaaacaaaaattccagatacagtgcaagaagaggtagtgatgaatgaaaaagcgatcactccagcagagctttcaagtcatggtggtttatgaagggagttagaattgcacctggggagcaagtgctgaggttaatggcagtgcaattccccgtctgttttattggaactgttgtcagaggcagaatgctgggctggagggactgtggccctagcaatgttttggacttgacaatgcccatttgttgggcatggttccggtgggatgctgtattatgcagctagagaatgtatttgtcctggaagagttcactttgttcactgccctcgagcctttatccaaggctaaacccacatgctgtacctacttttggaattggtccaggaattttatacctgtgtgaatktggagaaactctctcagacacccatttggaaatgcattagtgtttttctcagtgagtcctccatgcttgctgttccaatggccctccaggtttgggcccagcacctgccaggagaagcattccctctatagcttccacctgaccacagccagcccaagccctgctcagaaccccaggcctgccagcgagcctgtgactggaattatctattagggakcaagcattaacttgacacaggagcagccctggctcagctggaggcatccgcatgctgtggtgccccaggaacagaggcaccccygaaatgcargctgtgtgtttgctgcagagacaccatggcccataactccccaagcataagtgagcagctctgctgtccaggcaatgaagtcaagaaagggaaccaacccagctaatggctgggattaaagctaaatgaattcagctcaaatgaaagggatactgacccttctccctctggcctcattaacttaattaacagtgcttggcaggagtattgaagcctgcattgattgttctgtttctgtttttccccctcaaagccctagatacaagttaaatcagccttaataataaaaacccaatactcaacagccctcagattttcttaccagcccttcttcctctaagagaatcacttggtttctgagttggaggggatccattagaccaacacttctcagagcatggcctgagaccactagcttcagagtaactgggatatggctataaaatgcactttccaggcctcagaggcctgtggaactggaatattgagaagtccagtttgggtatttgtagtgggttttgggggtttaatttaatttttttaattgtggtaaaatagacatataattttcattttataaaaaatgtccattttaataatttttaggcagacagttcagtgacattaagtacattcacyactgtttgtctccagaatgttttcatcatcccagactgaaactctgcccattaaacgctaactccccatcctcccctcccagcccctggtaacttctgctctgcttcctrtctctgaatttatctattctagatatcttgtaagtggattcatgcaatatttgttcttttgtgactggcttattttactcagcataatgtcttcaaagttcatccgtcttgtaccgtgtgtcagaattccattcctttttaaggccgaaaaatatcccattatatagacaacaaattttgttcatttattcattcattggtggatatttgggttgtttccaccctttgactattgtgagtgatactgctatgaatattggtgtgcaaatatctgttgagcttctgcttccagttcttttgggtgtacacccagaagtggaattgctgggtcatgcgacagttagttctgtgtttcattttttgagtcagtactgtttttaagcagcccacatggttctaagctgcagtcagggttgcagccagaagaccaggtgatcagactctctgctggtggagtcacctgaagactctgaacaaccctggatgcccaagccacactccacaccaactaaatttgtaattttttaaagtctcctggtgattccrgtgtgtagccaagtttgagaaccattggtttccatcagtgattctcaaatttgagtgtgtataaaattcacacaatggctaaggatacagattcctgagagagcacaccaccacccccccaccaacaccacaacccccaccgccaccaccatcaccaccaaccaccgccaatcccaaagaggctcatttaatgcatctgtggtcagtctgggcttcctgggtctgaagacttcccaggtgattctagtgtgtagccaaggctgagagctactaatcttgttaagtctttcaatgaaacatgagaacactgagagtgtgaaaggtgacacactctgcccaagtccctgagctcgttaggttctgagtctgcactcattcccagggctgattttcaagacagtcccacgggttctccatactcagccttgcaggtgcagggggtagaatcttatatagaacctgcatcttttctactcttaatttgaactgtaatccttgaattagagtgtagtcagtgctgctataatgcttgttttggaatgtaaatttgtttctaacgtgattgatgtattagggaacaatattaatgtgttagggaagactattgatatgctggagaataatattaacatattcaagaatgtgaatttcacatttgcttatgtgcaatttyttgcatgtaaaggcagaaaactgcacccagctgtgccaaaacacaaaagaatacacaaaatacacctccaatattagtcagctacctcattctccatgtgtgatttgagccacatgcacccacatctgttgctgtaacttcccctctgatatcaaacaacccttcttcccccattcacaataactcactggcggagtgcggtggctcagacctgtaatcctagcaattctgaaggctgaggcaggtggatcacctgaggtcagaagatcgagaccagcctgtgcaacatggtgaaaggctatctctactaaaaatacaaaaattagccaggcatggtggtgcacacctgtaatcccagctactcaggaggctgaggcaggagaatcacatgagcctgggaagtggaggctgcagtgagctggattgcattccagcctgggtgacagattgagacttcatctcaaaaaataaaaataaaataactcacaagctgcaatctttcggatgtccacttccacaagcaaactgcaggtcattttcaaagtcaagtgctgtattatgtatttttaagaatttaacttggctaaaactgtgctaccttaagggggctccaatcctttttttttcyttttctttttttttttttgttttagayggagtcttgctcttgtcgcccaggctggagtgcagtggcatgattttggctcactacaacctttgcctcctgggctcaagggtttctcctgcttcagcctcccaagtagctggaattacaggcacccaccaccacacacagctaatttttgaatttttaatagagataggtttcaccgtgttgtccagactggtctcgaactcctgacctcaggtgatccacctgcctcagcctcccaaagtgctgggattacaggcgtgagccacagcgcctggcccaatcctttctttataggccactgttaagttttcaagtgtgaaacaccctagctctatttttcccatgagccttgtggtttttattgtgtgattttgcatagtgtaatgacttgtaaaaaggaatgtatgtcacctgatagaagaactaactgtagatgtaattatacacattgctttttagcatccttttaacaatgagtgagcagctcactgcccccttgagaattttagttcctgtccctctctttcctccctctataaccactagatggcgcactcctccgctggggtcgggcgcctttgcagcggcaacctcaacagcgtggacgccgttcttgaactctcgtctcactgaggtttgattgggtctggaacaacttcacagcctggttctcctctttagattggatttccccaatcccagtgctcattcaagatttacttccgcccactttagctctggcttctttttggatggtacttcttcccaggctatctgcaggaactgcctcgctgcacacacctctgctcacctgctcacctggttcctctgctcacctgtcctgccatttaacccacagagatctacttcagagacaaaaatctcgttatttcatgcctttctgtacttcataaagaaatctgtctgcgtggtatctttgtaatacgacataagcccagacaatgttctttcacatccatttgttcagctggccttatccaccttacttacttactttcattttagcttccctattaggtacttgaaaattcagtatcctggaacatatttcgtttggggctgtctttcacttatctttaccacaaattcaaggtcacccagtttggtggcatgtttgggaaccggcattgagtcatccataaaaacaaagaatttaaactaaaaaatgtaactgttcttcagagctggcattctcactcccatgtctgcagggatttctctggtttcatgagatgagaatttccttctcgtgtttggataaaatagcagctgcaaaactgtcagcaacttggggtccaagtttgttctttcctgcaaatactggtagttcaatattggaacatatttatatcttagagtcacttaaaatcctcatttctgaaatcaaattttctattctcttttcttctagaatagagatcagcaaactacggtctgtgtttggactgcaaaacctaaaatatttaccctctggccctttagagaaaatgttttctatctcctgttctagagcctaaagtgtgattgtttaacagaaactaagggtcctcaatgtgacatggagatggacaggcctcaggaagtcagcaaatcctctgaaactgggttcaaaatttggtttgtgatgcaaatgtgcatttttataggaaaaaggatcaaagctatcatcagagtctcaaatgggtccaagacttcaaaaggtttaaaaacatgttgtctacttatgggcagtgtgactgagcatgagagcccaccataacatcctaggtgtgagcaatgaagccaacatgcttacatgccttgttagggcacttcagaatctacttcatactataagatgtggaaaaggttatgtggaacccaatacaaatatggtctttccattaccatttattttcctccttgggtgtcaaggcctgttctcccccactattcttgtctcatctgaagtacatcttcagactcttcaccccaggtaccactgagtaagggctcatgcttcctaccacacacccttatctctgcctcccaggattatatcagcttctagaatcacagccttccaattgcacgccaggaaccctggagctggatttagggcccattgcaataactgcctctcatctcatccattgtgacatctgtccctctcttcatagattctattctgccctttttaggttggtttatcatcatgatgcatatttgatattattgaacactgtggggtgtcaatgctaaatgtgtaattgaggatggcagggacagagcagagcacctcccatggcacctgagaaagcctgtcccaaaccttggaggtaggagggatggtgcttgcctttaggagtttcttctgaactgtaacaccctcatctgccctgattggtttctattttctttcaataattcttcattttatctattgagatcactttgaacttttatcccattttccaaaatgcagcctcctgcctgtgtgtgtcatctataaatacaaggtcattasctctgaggcccatttgaagccacaagaaattcactgagacagaaagtggctactttgtttgcattactcaatctcatcacctacaaaagaaacaaacactggccaggcacatgcctgtaatcccagcagtttgggaggccgaggtgggctgattgcttgagcccaggagttcgagaccattctgggcaatatggcaaaaccctgtctctacaaaaaaagtacaaaaattagctagcatggtggtatgcacctgtggtcccagctattcaggaggctgaggtaggaggatcacttgagcccaggaaattaaggctgcagtgagctgtaatcgcaccactgcactccagcctggacagcagagtgagaccctgtctcaaaacaaaacaatcacaaactatgtagrtggaaagaatacataggattcgcagaattcctggctttagtcatcagagtgcctgtaaggaatgtggaaaaagacctggaagctttacctctcggcactgcagcactgtcagacccaggcctctgttttataacaaatatttgaaatgacctctttattattttgaaatgacattcatagctgtaacataatccacctacatacataattttatagaaatcaatatactgtcctaacttggatataaaaaagaaataaaaggggaagtaatttataatgagttggtacatgtctcaatgtgtgaatgcttatgtgcaactagaagatgaaatgagttaaacactcacacctacttataaagaagatgcttggatttaggagaagtaaaataatattcaactgacccttcttaaacattttttttccaaggcagggtcttgctctgtcgcccaggctggagtgcagtggcacaaacacagctcactgcagcctcaaactcccaggcttaagctatcctctcacctcagcctcccgagtagctgggactacaggtatgcaccaccatgcccagccaatttttgcattttttggtagatatgggtttttgccatattgcccaggctggtcttaaacttctgggatcaagtgatctacctgccttggcctccccaagtgctgggattactggagtgaacctccacaccctgcctcttctcaaacttttttattacacttgacattttgaaatgaggactaagtaaatttgctcacacataaatgctaccaccatatgatgcagatgggcactgtttgtgacattgtttgattctccacagaggcactggccatcatgaagtgattttctgaaatggtgaataacactgtcaataaaaaaaagtcaaactctgcaaaatatttcgagagtttattccaagccaaatgtgaggaccatgacctgtgacacagccccaggaggtcctgagaacatgtgcctaaggtgttcaggctacagcttggttttgtatattgtagggagacacgagacatcagtcagtctatgtggggtatgcattggtttgtccgaaaggtaggacaactcaaagcctggggcttccaggtcataggtggattgaaagactttctgactggcaatttgctgaaagaatcaagtttttatctaaaggcctggaatcaaggggttgtgaagaaaggttcttatgcagatgaagcctccaggtagcaggctttagaaagaatagatggtaaatgtctctttcatgagaactaaaaatgtgccagactcttaattaaatccctcctggatcaggaaaagacctggaaagggaaggggattctctacagaatatagattttcccacaagagacaactgtgcagcgccctctcaaaatatgtcaaagaaatgttctattttggggtaaaatatttaaatttctttcaggtcctgctatctgttgtgttgatatctttttattttattttattttattttattttattttattttattttattttattttattttattttattttattttatttttgagacagtctcactctgttgccaaggctggagtgcagtggcatgatctcggcttactgcaacctctgcctcctgggttcaagtgattctcatgcttcaacctcccaagtacagatgccaccaccccgcccggctaattttttgtatttttagtagagacggggttccaccatatcagccaacctggtcttgaactcctgacctcagatgatctgcccaccttggcctcccaaagtgctgggattacaggcatgagccactgtgccaggcctgttgtgttggtatcttattgctacaaagagtctgttctatcagtctgaagatctctgttttaatgttaacactggtcagttgtgcctgaattccaaagggaggagggtataatgaggcgtgtctgaccccctcacctttcccatcatggcctgaactagtttttcaggtttttttttggaatgtgcttggccaagagaggggtgcatcagtcagttggggagcttagaattttatttttggtttataacactttattaaggtccaaactaaacaaggtagtctttcctagattgacacagtagttgcattcctgaaaaattcagtatatattaaaaccgtgcaaaaactattttgttagcatgtaacacaaagttaggttctgaggkaattttgagcaagtttttgacccttggggactttgggcaggacatcctacagctgtgtggatgctggctgattctgcatggtacgggactgtcatgcacgtgtcaaccaaaaattaaattctaaggccccacaaccatctgaatggactttctttctcttctttttcatttcttttcttttcttttgagatggagtctctctctgtcacccaggctggagtgcaatggcacaagctcagctcactgcaacctctgcctcctgggttcaagcaattcycctgcctgagcctcctgagtagctaggatttcagacacgtgccaccatgcctggctaatttttgtatttttagtagagatggggtttcaccatgttggccaggctcgtctcaaacccctgacctcaggtgatccgcctgcctcagcctcccaaagtgctggggttacaggcgtgagccaccgtgcccggcccatctgaatggacttccttctaggtcagggcactctaaaatttaacctaaaagtctggtttaggccatgatgggaagtggaggctgaaaatgcctcattatacccgtcagcattaacatcaacacagaccttaagtctgatgagaggcatttatattatattctctgtagcctgctacctggaggcttcatctgcatgatcaaactttggactccacaacctcttatcacaacccagacattcttccctattgataactctttttttttttttttgagatggagtcttgctctgtcacccaggctggagtacaatggcacaagctcagctcactgcaacctctgactcctgggttcaagcaattctccttcctcagcctcctgagtagctaggatttcaggcatgcgccaccatgcctggctaatttttgtatttttagtagagatggggtttcgccatgttggccaggccggtctccaacccctgacctcaagtgatccacctgcctcagcctccaaaagtgctgggattgcaggcgtgagccaccatgcctggcctctattgataactctttcaaccaattgccaattagaaaaattttaaatctacctataaattggaagctccctcgcccctccagttgtctcatgcttctggaccagaccaatgtatatcttaaatgtatctgactgatgtctcatgtctcccaaaaatgtataaaaccaagctgcaccctgaccaccttgggcacatgttctcagggtctcctgagggctgtgtcacaggtcgtggtcctcacatttggcttggaataaacctctttaaatattttacagagtttgactcttttttattgacagcgttattcaccatttcggaaaatcacttcatgatggccagtgcctgtgtggagaatcacatatgtggcactcatatttagctcagaataaatctcttcaaatattttacagtttggctcttttcattgacatacattatcatgacatcttgattacaggggtgatacccacccctatcactgtgacaaccaaaaatcatccctgcaaaattacagtttcctaggaggcagctgtccccatcaagagccacggcttttagagtgttacagataaaatgcactgaggcaaaggtcctcgaacagatccaatccctttatctttctgttgatggcagtgttgttcattcaacatactctttcctttttttcttttcttttctttttttttttttttttgtgaacaccatgcttctttctgtttgctgtatggagaatatagtctaccaggggacagagatgataagtattgagaggtgacagcgtgctggcagccctcgctcactctcggtgcctcctcagcctcactgcccactctggccgtgcttgaggagcccttcagcccaccggtgcactgtgggaggccctctctgggctggctgaggccggagcaggatccctctgcttgctgggaggtgtggagggagaggcacaggcaggaaccagggctggggtgctcacgggccagcgcgaattctgggtgggcgtgggcttggcaggccctaactcggagcagccaggggcagtgaggggcttagcacccgggccaggagctgcgaagggggccccgggtcccccagcactgccggccccgccggcgccacactcgaattctcgacgggcctcagccgcctgcctgcagggcagggctcgggacctgcagcccgccatacccgagtccccctgtggtgggctctcacgcggccaagcctccccaacgggcgccgccccctgctccacggcgcccggtcccatcgaccacccaaggactgaagagcacaggcrcatggggtgggactggygggcagctctgcccctagccctgacgcgggatccactaggcaaagccagctgggctcctgagtcaggtggggacttggagaacttttatgtctaggtagaggattgtaaatacaccaatcagcaccctgtgtctagctcaaggtttgtaaatgcactaatcagtgctctgtgtctagctaatctattgtaaatgcaccaatcagcaccctgtcaaaacggaccaatcagctctttgtaaaacagaccaatcagctctgtgtaaaatggaccaataagcaggatgtcggtggggccagataaggaaataaaagcaggctgcggcggccagcagtggcagcccactgcggtcgtctttcacaccgtggaaggtttgttcttttgctctttgcagtaaatcttgctgccgctcgctctttgggtctgcactacatttatgagctgtaacactcactgtgaaggtctgcagcttaattcctgaggccagcaagaccatgaacccacagggaggaatgaacaactccggatgggaagaatgaacaactccagacgcgccaccttaagagctgtaacactcaccgtgaaggtctatagattcactcctgaagccagcgaggccatgagccccccagaaggaagaaactccraacacgtccaaacatcagaaggaacaaaycccagacacaccacctttaagaactgtaacactcaccgtgagggtccacgacttcactcttgaagtcagtgagaccaggaacccaccaatttcggacacagtatgataaataagcaaatagacaagacaagtaagggcttgtgatcattgctttgatggaaataagatggtttttgaaagagtaacayggcaggggatttatttcaaatagtgtgtgcaggagaagtctcgctgkggaaacactgatgtgagatctcgccrcagtaagagcagagagaagagggttcacatgaaggaagcagcacttgcgaaggtcctgaggctggaaagagtttggaatgcgtaccatgtgtgtattccaggatggctggtacttccaccctaggaccttggtgctggctgctcctttccctcaaacgttgggcctctccacatcctttccttacttctgttagacacctgctctaatctcattacatcagagacacccttcctgactcctctctataaacagcagccaccacccgagccatggcacccccatctcctttttcccactttactttcttccattgcatttacctctrcctgtcagtacctatttcctcttccttttgttgtctatcacctcttccgtccaccagaatgtaagctccatgagggcaggcttggtccattttgctcacagctgtatctccagctcctaaaacaatgcctgaggcttggtgtgctggctcatgtttgtaatcccagcactttgagaggccaaggccagtggatcacttgaggtcaggagttcaagaccgtcctgggccaacatggtgaaaccccatctctactaaaaatacaaaaattagctgggcgtgctggcacacatttctaatccaagctactcaggaggctgaggtgggaggatcacttgaacccgggaggcggaggttgcagtgagctgagatagcaccgctgcactccagcctgggtgacagtgtgagaccctgtctcaaataaataataaataaaacagtgcctgacacataatgggtgctcagcaaatttttttaatgagttattgaggagaaaaactattcaagataatgttgacaagacagccaagagctgaatcatgtaagtactcacaggattttattccaagtacagcaggaaggaagggaagggccctgtacaaagaggaatgatataaaccagattatgtttttgaaagaacatgctggctgctggctggaaaatgaaagcaagaccagaaataagagagccagtgaggagtctccagtctggcccaygcaaagagatggcggcggcttacagtagggcagtggataggcttgggaggtggcaccaacaggacttgctgagggattggatattggggggatgtttaaaagaatgatgtttaaaagactctgctgtgttgtcaccctgagactctggatggatatggtgaagccatttactgagatgggggagaaattcagagtggtgataaacattctcaccaagtttttcctaacgattattagatgcctgagtttgaaactttgagtcaatccaggcatccatgcctacttctgatttgctgtagcttgtgtgccacagcctcccagtttctgtgraaaccccaccatacatcagccccagcacaaagcacaacctcgtcagagctagcccacctccagcacyktgactgctccaggcttaatctctcctggtgttgacacttttgccagtgatggtgtctcatgggattcatgctctttataaaccattgccttcttcctatttctttcatttatttttcctctcattctcctgccctctgagctatataactcttcctttaccttccaacagaggcctttcattacatttaaagcaaatggaatgcatagtaggcaccaaagatggaggtgctrtgcaaataatagacaccaagctctctgcaggtggggtccttgtgtgttttctcttcatagcacccagcacaatacttggaacataagccagacacgttcattgagcaccatttctgctgcacccatgaaaaaaacactcaacccagacagatggtyagctccccgacaggacttaagcaagtgggccagtctctgtttattgtcgtacactcacacaatcacacagctgccaggcgagcactaggcacttatcacacttttattaaaccgatcacatctggctctttgtggggtgccagaaagtgcccaatttctgcatgatgggatggactgtgtgtggagtaaggtcggataaatggagatgggccagtagcctagacaaattaagggagaaaaacagtgaatttattttccactcatcagccgagctttctgtgggctaggaacggggtacccggctgaagtgaagcaacattgtgtctcttcctgctgttttctccacctcccctcagcaaatcatgaatgaataaacaaacgaatgaatgaasaaacatagagttattataaggattaagtgaaggcagggtgcagtggctcatgcctgtaatcccagcatgttgggaggccaaggtaggaggatcgcttgagctcaggagttgaagaccagcrtgggcaacaaagcgagacccccatctctatatttttattttaatttagaataataaataaaatttttttaaaagaaaagattaagtgaaatgttttttaagtacctagaatagtgcctagtatacagaaaattcaacgtaagtgtttgatagagagcaagaataggccaggtgtggtgactcacatctgtaatcccaacactttgggaggttgaggcaggcaggtcacttgagcccacaagttggagaccagcctgggcaacatggtgaaaccccatttctactaaaaatacaaaaattagccgggtacagtggcacgtgcctgtagttccagctaatcaggaggctgagatggaaggatggcttgaacccgggaggcggaggtggcagtgagctgtgatcatgccactgcactccagcctgggcaacagagcaagaccctgtctcaaaaaaaacagaaatagagtaagaatagttttgtctgtatctgccaacagccacgtctgtggagtcagaggaatgaaggggtcaaagggagcaggcacatcatagagaatacccccaagatctgaagaccccagtgcaatacctcgagcttaaatgcctgtgttttcattctcccttcttctccataggatcatgggagaccacctggaccttctcctaggagtggtgctcatggccggtcctgtgtttggaattccttcctgctcctttgatggccgaatagccttttatcgtttctgcaacctcacccaggtcccccaggtcctcaacaccactgagaggctcctgctgagcttcaactatatcaggacagtyactgcttcatccttcccctttctggaacagctgcagctgctggagctcgggagccagtatayccccttgactattgacaaggaggccttcagaaacctgcccaaccttagaatcttggacctgggaagtagtaagatatacttcttgcatscagatgcttttcagggactgttccatctgtttgaacttagactgtatttctgtggtctytctgatgctgtattgaaagatggttatttcagaaatttaaaggctttaactcgcttggatctatccaaaaatcagattcgtagcctttaccttcatccttcatttgggaagttgaattccttaaagtccatagatttttcctccaacmaaatattccttgtatgtgaacatgagctcgagcccctacaagggaaaacgctctcctttyttagcctcgcagctaatagcttgtatagcagagtctcagtggactggggaaaatgtatgaacccattcagaaacatggtgctggagatactagatgtttctggaaatggctggacagtggacatcacaggaaactttagcaatgccatcagcaaaagccaggccttctctttgattcttgcccaccacatcatgggtgccgggtttggcttccataacatcaaagatcctgaccagaacacatttgctggcctggccagaagttcagtgagacacctggatctttcacatgggtttgtcttctccctgaactcacgagtctttgagacactcaaggatttgaaggttctgaaccttgcctacaacaagataaataagattgcagatgaagcattttacggacttgacaacctccaagttctcaatttgtcatataaccttctgggggaactttacagttcgaatttctatggactacctaaggtagcctacattgatttgcaaaagaatcacattgcaataattcaagaccaaacattcaaattcctggaaaaattacagaccttggatctcygagacaatgctcttacaaccattcattttattccaagcatacccgatatcttcttgagtggcaataaactagtgactttgccaaagatcaaccttacagcgaacctcatccacttatcagaaaacaggctagaaaatctagatattctctactttctyctacgggtacctcatctccagattctcattttaaatcaaaatcgcttctcctcctgtagtggagatcaaaccccttcagagaatcccagcttagaacagcttttccttggagaaaatatgttgcaacttgcctgggaaactgagctctgttgggatgtttttgagggactttctcatcttcaagttctgtatttgaatcataactatcttaattcccttccaccaggagtatttagccatctgactgcattaaggggactaagcctcaactccaacaggctgacagttctttctcacaatgatttacctgctaatttagagatcctggacatatccaggaaccagctcctagctcctaatcctgatgtatttgtatcacttagtgtcttggatataactcataacaagttcatttgtgaatgtgaacttagcacttttatcarttggcttaatcacaccaatgtcactatagctgggcctcctgcagacatatattgtgtgtaccctgactcgytctctggggtttccctcttctctctttccacggaaggttgtgatgaagaggaagtcttaaagtccctaaagttctcccttttcattgtatgcactgtcactctgactctgttcctcatgaccatcctcacagtcacaaagttccggggcttctgttttatctgttataagacagcccagagactggtgttcaaggaccatccccagggcacagaacctgatatgtacaaatatgatgcctatttgtgcttcagcagcaaagacttcacatgggtgcagaatgctttgctcaaacacctggacactcaatacagtgaccaaaacagattcaacctgtgctttgaagaaagagactttgtcccaggagaaaaccgcattgccaatatccaggatgccatctggaacagtagaaagatcgtttgtcttgtgagcagacacttccttagagatggctggtgccttgaagccttcagttatgcccagggcaggtgcttatctgaccttaacagtgctctcatcatggtggtggttgggtccttgtcccagtaccagttgatgaaacatcaatccatcagaggctttgtacagaaacagcagtatttgaggtggcctgaggatctccaggatgttggctggtttcttcataaactctctcaacagatactaaagaaagaaaargaaaagaagaaagacaataacattccgttgcaaactgtagcaaccatctcctaatcaaaggagcaatttccaacttatctcaagccacaaataactcttcactttgtatttgcaccaagttatcattttggggtcctctctggaggttttttttttctttttgctactatgaaaacaacataaatctctcaattttcgtatcaacaccatgttctgtctcactaacctccaaatggaaaataatagatctagaaaattgcaactgcccttagaggtttccagtctccattgattttctttcagatccaataataccgttctgtcctgctgtgttgattatggaatgtatcctaatcatgggaagggcaccttgggagaagttgcagatggctgacgtgctttctctagcattcagctaaaaaatgggatggtccatgattctgygttctctgtgttctgcaaaacaacattaagtagaaaacaaacagaagcagaggcacatttccttcttttgccacagaaacaatgccactgttgagtgcaagtcacactttgtctcatagataagaggtggccccaaagaagctgggatgaatgagtcactacctgtcttgtgactgtactgcacttcatgttcttaccttcggcttctccaggtctcgccctagtgagccaagaactttctctcacatgctgcctttatttaagcctggccttcaagaccttccatgatttatcaccaacctaccttttcagctttgtttcctagcacacctcattgatcagctgctcaggctgttgcatgaagaacatggactttgcacacagatcctgggttgagttctgagtcagctgtgtattagccatgtaaccttggccttggtatgcccttgctggacctacattttctcacgtaacagcatctatgtcatagaattcctgtgaaaattaaattggccaaggatgtcagggcttctcagatcttttctttcgttgccctaatgaccacaagagaacacatacactgaaggcctcctggggggcagttgcaatttcactgaagttgtatttttttatcttaaatgaaatctatgtgtattttccattctgttctttttttcatgtttattaatatagaaatgtgtttttgcaaaaggattaagaatacttaaaacaaggaaactgtgccaaaattaccccatagcttcacacactgcctcctccaagtccagcgtaactccaggtcagctcctgcagtttgaggggtacacatgggtctgggactcagctctccaaactgtcaccttcttcccctcactgggcccctcaatcctgactcctccaacacacacacgcgcgcacacacacacacacacacacacatacacgctattctcatcccaacttcttttggccacttctaatcaatgagaccgagctttccctgcacccagcgatggcattattttcacgcacaccatgcagtccccactgtacctctttcctctggattcttctcccatctctgcacatccatcctacgttttcttcgttttcttcaaaatccagcccatgaagctccctgggatccctaacccaaagtcctctctcccttttgtgaaaactcttgacactttatctggtcttttaaaagtagcacttactactacttcctctatccttttttctgagcctgcccggctgcccgcctctctggaagataagttccctgaggaaagaccttgtcttctgtgtcctgccctcactggctgtagcagatcacttatggtttggggaccattcaagggtttcccacttacacatctgcccatgcttcttcctccccatggaatttcttctccccatcctaccactcgtctgcctgatgaatttccttgtttagcaagactgcccatccctcatgaccccagtgacagattttctgtcactgatacatgacattgtgttgcgccagtgtgtttatgtatgtgtatggacggcttagtttgtgagacactgcagtcaggatcttgtcttgttcatctgtgtatcgcaggcccagtttgtgcctggcccacagtatgtgcttagtaaatgtcttgtggatgagtgaagtatactgggaagcccagcctccctcatrkcaacacctgctgttattagactttccactggaggggcagggaggatgagggcctgagagagcaagatatccatggaggtgctgagtggtaagctgaaaagggcaggagaccacaggctgtcagacacccctgaacactatttcaaatggccaggcatggcacaggcctcctgggtagtgggacagtggcagcctggattagcagctaggaacggggctagaatggagagctgagggggtggggaggaaaacagaacccacatgaatttgcagtgaataaggtctcctggaaccctgtgctaagaaatacagtaaaacagggccaggcactggtggctcatgcctgtaatcccagcactttgggaggctaaggtgggccaatcacttgaggtcaggagtttgagaccagcctgcccaacatggtgaaaccccgtttctactaaaaatacaaaaattagctgggtgtggtggtgcacacctgtaatcccagctactagggaggctgaggcaggagaattcctcgaacccaagaggcggagattgcagtgagccaagatggcactactgcactcctgggtgacagagcgagatcctaactcaaaaaaaaaaaaaaaagaaggaaggagacaaaacaaaagtatactgtgtcagtaacaggtataaccgcaaatcaggaagactgtggaaagaccactctgctcggtttcatgccctcctgtcccacctgctgctcagccatggttttcccccagctctagggggtgggaggggcacccaggacactgaagaaatctcctggtcagaacaccttgtatgaacaggactcctagggaaaggggtttcctagtccggctaggggttggaggtagtgctacaccagggacctcccttggtttgggtgaccatcgctatgactctgttttccaaaccaaacctgggacatgtaaaatgacaagtgcaggtgtctttacaggaagaacaagctgaaacacagataactctcaacataggaaaggagtctatcccacagccttttctaatcttcttatttaaaaacacgaattacaggtaattttcctaatgaaacacatttaaaaggcatcttttgtggtctctgtatagagtgtatgggggacctgttcatgtctacatcctagccactgttagtttcaacataccactctatttcaaaacttcccttttctggcaaagatccaaaacttactaaaattcttttgtcttctttcccatggtcaggcccagcagttggaattctttttgaggccattttcccaagtctttatcacktcacaagacttgctgtgtacatggcaaaaggaaggcccaacrgagccacattgggaagtgggccctggggagtctgctgagacactggttgctaagtgactgccctgtcttccatggcgcagtgattcaaagccaggcctcaggaaatagataaattccacatagcacagacctctggggtcactccaaaatggtgagaaactaccacagttcaatctcagaatggctagagctttctgtagttgaaactgcaactattctggaaagatctagaatattgactagagctgctgaaaacttcaaagagaatcccactcatgccaaatacaactgactctgaaaatcccttgccaaccacgtgcacttgcagtgaagaatgttttagagagtcttgatattatgtaaagcaaatgcggtttgaagttttaaatcatgaaagaaccacgttaagaggacaagagactgtggagtaaaagtttaagatagttaaatgctcatgtaccacaatgtaaaattgattacaaaaaagtctacaatattaaatcaagaaatagtgttccaaatatatatatttagaagtatgaaaatgccagaagaaagaaccatacaaattaatgatgattgcctgaggaagttctgcccagttcttccattgggagcatctagaaaagctggagaaactatttttttagaatctatttaaagacacgggaaagttgcaaggtagtaaatagggccaagaggcaagagaagaaggaaatcgagaaagctgactacaatgcaattaagaccatctattaccaaaaaaagactatcagtgaatgaaaagggaaactttagcatggagggagatatttgtaatacacgtatccaaaaaggactcacaggcaaaatctaaaagaacttctacaaatcaataagaaaaagactacagaaaagaaaaatggacatgacacttaagaatttcacaaaaggctatccaatgtccaataaggaaacgaaaagatactcaacctcctttagtgatcagagacacgcaaattgatacaacattgcaatcccactacccacccaccagaatggctaaaattaagatgactgacagtaccaagtattggcaaggctggggagcaattgaaactttcctgcgtgattggtgagaatgtaaattggcatactataaagcagggttccccaacccccaggccatggacccatactggtctgttaggaagcgggtcacatagcaggaggtgagcggcaggctagcaagctaaacttcatctgtgtttgcagccactcctcatcgcttgcattactgcctgagctccacctcctatcagatcagctgcggcattagattctcataggagcttgaacttcgtgtacgagggatctaggttgtttgacccttatgagaatctaatgcctgatgatccatcattgtcttccatcacccccagatgggaccatctagttgcaggaaaacaagctcagggatcccactgattctacattgtggtgagctgtataattatttcattatatattacaatgtaataataatagaaataaagtgcacaataaatgtaatgggctcgaatcattctgaaatcaccccacccctatcccccgccagtcggtggaaaaattgtcttccatgaaactggtccctggtgccaaaaagttgaagactgctacttttattttttattttgttttattttttagatgaagtctaactctgttgcccaggctggagtgcagcagcacaatctcagctcactgtaacctccacctcccaggtttaagcaattctcctgcctcagcctcccaactagctgggattacaggtgcgtgccaccacactcagctaatttttttgtctttttagtagagatggggtttcagcatgttggccagactggtcttgaactcctgacctcaagcaatctgcctgcctgggctcccaaagtgctgggattacaggcgtgagccactgtgcccagccagagactgctaccttaaagaacagttagtcgtctactaaagttgaaccacacatgccctgtgatgctgaaattctactcataagtatatacacactagaaatccatgcacttatgcgtgaaaacacacatagaaaaacgttggtagcagcattatttgtagtagccaacattggaaacgacccacatgtccatcaaccacaaaatggatcaataaattgtggtaattgaaagccctacagaaatgacaattagccaattatagctacaggtaacaacataagtgaatcttgaaaaaaatgttaagtcaaagaagcaaggcataatgatgaaataccaagtggttgcaatttgagaaattttaacaaggcagaactcatctgtggtgataatgaggacagtagccacctctggggaggagtgagtagcgctggagggggcttccaggatgctgtgtatgttttatggcctgacctgggtgacagcaacacttttgataatacatcttatcggcactgatgaatttgttcacttttctgtgagatactagttttccatttaaaaaacaattttttgagatggagtctcactctgtcacccaggctggagtgcagtggcgtgatcttggctcactgcaacctctgcctcccgggttggagaaattctcctgcctcagcctcccaagtagctaggattacaggtgcatgcaaccaggctcagataatttttgtatttttagtacagacagggtttcaccatgttggccaagctggtcttgaactcctgacctcaggtgatccacccacct

SEQ ID NO: 17715 - DNA, 19462 bp, Homo sapiens
aatttagctgacataggtggatgttctttacaaatgaattttgctagaaattgataggaagaacaaaacaaaaaacatgaaggcataaaaatggatgagtgtgcaggtaaggattgcttggttagccaagagtttagttactggcttggctgatggctcagcagacacgcaggcctttctttccctcctagtttaggttgaatgactcatactcaccaggttgaggctaccattttatgaagcttcaacccttatcttaggttagtgctcattcagtaatatactcactgagtagctgctatacactagaaactgctaggttctagggagaggaagatgattatagactctgccctttgggagctcaagtgtagaggtggaaacagacaaggaaatacataatataagcaggtggtaagtttggtaaaagaagtatgtttttgggctgggtatggtggctcatgcctgtaatcccagcaatttgggaggccgaggtgggtggatcacctgaggctgggagttcgagaccagcctgaccaacatggagaaaccctgtctctaataaaaatacaaaaaagttagccaggcgtggtggcacatgcctgtaatcccaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaagtatgtcaaatagaagcactgaaatgcagttatagaaggcttgctggagaggtggtatttgagctcagtcttaaggatgagttagtcaggcgattgggggtggaatcagtctaagagggagaagagcatggtgcattctgggaactgcagtcaagcacaggggtgagagcagggccagctccatagtcattacctgtgtgatcttgggcaatttattttaacatctctgagcctaatttgctcatctataaaatgaggataataatagtgtttttgtcatagtgtcgttgtgaggattaaatgagttagcacatgataaagctcttagaacacagaatcatcactggctgggtgtggtggctcatgcctgtaatcccagcactttaggaggtcaaggcaggtggatcacttgaggtcaggagttcaagaccagcctggccaacatggtgaaacccggtctttactaaaaatacaaaaaaattagtgggcattgtggcaggtgccagtaatcccaactactggggaggctgaggcaggagaatcgcttgaacccaggaggcggaggtcgcagtgagccgagatcgcaccattgcagtccagcctgggcaacaagatcaaaactccgcctcgaaaaataaatttttttaaataattaattaattaattaattaattaaaaaagaacatagaatcatcagggtgtatgttaccaagagacagtatagggaaagagggagagagcccacacatgaaggccgagggacagtgagtgtcttctgtggcctcccaaggagtttgggctttatctgtgtatggtagacagctgttgcaggattttaggacggttgacttttgcattcctgtagtacctggaatcaggtgcagggtctggagtcacctgtaggagtggtagagccctctagtggcagtctgtagaatgcagtgggagaaagacccggaaaaggggagtaattgacgaatgccaccgttggctggcgaggtggctcacacctgtaatcccagcactttgggaggctgaggcaggcgaatggcttgagcccaggagttccaggccagcctgagcaacgtggtaaaaccccgtctctacaaaaatacaaaaaattagctgggcctatgcgcctatatgttcccacctacttgggaggctgaggtgggaggacctctggagcctgggaggtggagattgcagtgagctatgatggcgccactgcactccagcctgggcgatagagcaagaccccgtctcaaaaacaaaaaatgaaaaaaaaaaaaaaaccccaggttagacggcttgggtgactaggtgtctctcagaagtgagatttgtatgcaggcgtaactagatagtggtgcttaaacaaattcaaaaagtagacaaaaaacgggtgtcagaaaagcgaataattccagtgtagacatccagatattaggagacccccaggtagtgagagtggtcgcggaggtggctgggtagttgtgactcagtatcaaggagtgggggagccacggagtccacagtttctccgagagcatgtcaggtgggaagaggtcagagagggatagcccgctgatgctgtctccctaccgccagtctggcctaactgtggaacttcctcttagggtcctgtttccagagggactcctctattcttggctcatcggggattaatgatcaagcccttcctgcctagttcccagctctgccccacttttccagctgtccctaccctctcagaggcccccttactgctgtaggaagctctcccgagttctctccacagtccccttagtaagcgggattccagcccgtaccagagagggacaatcggacagccgtggcggtgggcactctctgggaaagagcagcagctcaggaagacgagccacaacagaactgtgggagcatctagcttcttctggagagcgggagggccggagggagggtcttgcagccctgcagacagtgaggggctgggggagtgactccacggtaaactccttcctatttaggatgcagctggggctggagccaggtctggctatcgtggtcgccgctcccctcacaccccccatgaacgcttcgaggggctcacggtgcttaaggctgckcaggtgagcacaggaggcacccgggcccgtctgatgcccagacctggaggagaggctgtgcaggaagccgggccccagggcctgggcttttgtgaaggagctttcttgggaccgagactacctgataggacccagcgtggagaaaagggatgttctgagagctggggccggggttgttgtcatggagagagaaggagcagtttgggctgatggacagagctggatgctgacagactccaaacccaygggtggagagcggcagagttgggcaggggctagggccgagaccaccctccccttgccttcctccttttctgccctgcctttcactgcctgcagctggcccgggctgggacagtgggcagtcagggtgctaagctgcttctggaggtgagcgagcgggtgcrgaccttgacccaggcctacttctccccggaacggcccctgcatctgtccttcacccacctggtgtgccgcagcgccatagaaggtacgacagggaccccccactgctcttctccaacctcaggccctgcccccaggacactgcccccaagagccccggggtggacgtgcacggcctgagcccacagggtggcagatgggcacaggggcacagaggtacccccagacccctttgtgtcctaggagagcaagagcagcgcatggacctgagtcacccagtgcacgcagacaactgcgtcctggaccctgacacgggagagtgctggygggagcccccagcctacacctatcgggactacaggtgggcagcccctctagtggtcaggcaggtgggcagacaaaggtcatcccactgccggcctgggcctgggttggggtctcactgcctcttgcttttttccctccccagcggactcctctacctcaacgatgacttccagggtggggacctgttcttcacggagcccaacgccctcactgtcacggtgcgtggagtggggggtgtgacggtgtgacaaagggcccagctgtggggtcaggattcaaaacagaaggctccagaggcaaatgcagggaaatggccagggcttttaaccctttcacttccccgcctccgcagccctcccgctgcttcctccgtagcaaggtctctaagtggccgaatcaaccctaccatcagtatttgtctcgcctcctaaagaagggtgaatgaagcacagcttgcaggtgcctccaggactccatggccctattctagggatttggggaacttgaaatagtccttcctctttgcagcgaggtgagcacagtggctggcgcacagataccagggccgccttgactggggctcggattctgaacctttctgaggtttagtttcctagactggggtgataataatagtacgtattttaaagggtcattgtaggaagtaatttaggtaatgtacctaaaagaatgaggcagcgcctggtaatgataagcaattaatgaatgttaggtgggaaatttccggacaccaggggctaggattgggtaggaggagaggggcagtgattgttcatctgggtgtggggtgtgaaaatggttccaatatctgtatccccttctgcatagagtctggtactgcatgcacagccccagattgcttcaagccctggattcaaagggctgagtgggaaaaatcagggtaccaggggtcaggaaccaacaggagaccatccgtggagacccctttttcctttggttcccaactcctcttgcatttttgctctgcaagttgaagctgatttctcatttgccccaagctagtccctgaattaaggagtaggaagtggtagcgagagagctgatcctctctgtgcccctgtccccatcctgctctagggagtgagggccaagttctctgagagagccaatccctggagctgaacctgccctcatccctccaggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggtaaggagcggggtaggaagggatgtggttctcctggtgcgtgaagggtgggcaaggagcccccgagaaggctcacagtcggtgagggtcaggggctgagctgacccagggaaggtgggtgcagggaatgggccacactctcctccccaaccccaggagtggatagaagccaaagaactgctgcaggagtcacaggaggaggaggaagaggaagaggaagaaatgcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacrcacaggaagcccctgtgtgacatcaggagcagaacagcaagctctctgtccctgcacccccaccatcttggggacctacaagggcctggactcagaggacagtgcacaggctagcctggagctcaccaggcctggggagctgggacggggccccgctgccggacctgcagccctggacagatggggaacactgtgcctccctgaacggaaatggcaggggaggaggctgatgctttaaatgaagaggatggtggggttgggaggtataaccctgctcctctctcccagtctgtgcaataaaggtcgtgaagatctctcagccaggggccagtcragtgtatcacagattctgtgatggctggaggtgggggtggctctggctggcctgggaggagacaggtgtctttgggcctcccagaggcggggcgcctggagcctgtgatttgtcagggaaatctcagccacctgctcccctcatgcaaatgacccaagcccctggcagctgctccttaggcctccaagtgtaagccctgtcttccctctctgagctttgctgagacttagggccgcctgctttctctctgacccctgctttcacagcctcgagagggcaaggagggggccagaccccagcctgggagcagcgtgcgggccttccctccacttgaaatccgttgcccgcccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggtactgacaatggggccatctatcacccttatatcccacctcctggcctggttgctaagtggccctgactgccaagatcatcaccatggatgggggccgggaccaggggggccactggagctgtagttgtctgctcctttgcacccctcccaaaccccaacccttaatcctcacagctttgctctaatcctgtggggcctgatgctcttatctctgcctgcagagactgaccagggaagcaccccttcaccccctcctctctcagggcttgtggtgggggctgcccctctctatggccccacactcctgcccccaaccctcctcccggctgggcccaagtctctctggaatccgtacacctccctccctccccccaccccttccccccacccctgccagctgatttcatttgcctgacgttgtggttggctctacccttccctgtcaggcccccccaaccccccgccrgtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagtaagagggagctggcctgggctctgctctcctgggctggggcgcaggcagggctcaggcaggctggggctggacgcaaaggacctcaaacttggagggcctagctggggagagggtgcagccacccagtcgtttccctgtgtcttggagtctggtgtgggcacgaagggcagaagcacagcctggtggggggttcctcaacaccraccccatgttcctggcaggagccagagtgacccctcgacctgtcagccatgggggagatggagcaactgcgtcaggaagcggagcagctcaagaagcagattgcagtaactccagagccctacccctggggccccagaaaacagctggggacatgaggagcgtggcccagggggagggggctgggtttgctcttgagtgactagaagtgaccagggactttctaaacttggttcgcatatttgagacccccaagccccagagccccaagaccaacctgccctgaaggcccatgcacctgccacccccacctcgcccttgctcccctgatgtctgctttccctgcaggatgccaggaaagcctgtgctgacgttactctggcagaggtaagaccccctgtcccccggaaggcagggcatggggggaggggaagggagctccccgacccgcaatagcgcgttgctccgagcattagtacagcacgtccttggagtgaggaaacccattaattaattcattcgaccaacattttagcgggacctgctctgagccaggcaccatattggatgcgaaagatgcggacacggttcctattctcatccgtagaacaagagtgaccacagccccctcccagggccttgaagatgaagaagcgatagtactttgtaaattataaagcccttgtagactctagctgctagttttctatgctgtattttgtcaattctaagatgcacatttcttcacattttgacatctctgaaatcaaggtgcattcagcaatggatcattgtttcaattagaattgacagcatcttttctttcttagtgatgcatcttagattggattaaatatgttaatagtgaacactttttatgagccagatactgggctaagctgcataaatacctgatttcattgaattttcatgatatctctgtaaggtaggtgctatgataagcctcattttacaccttgagtaaacagactcagggaggtgaagcaacttgcccaagataacaaagcaggccgggcgcagtggttcacgcctgtaatcccagccctttgggagactgacgtgaaaggatcacttgagctcaggagtttgagaccagcctgggcaacatagtgagatctcttcttaatataaaaaaaattgcttttaactttttaaaaaaagatagcaatgcaagtgatggcaaatcaagtctgttcactctggacccccagcctaagtctaaaatgtggttagagctcaaggggcatagtaccacagatttcaggaggtacagttcagggtcatggtgatgccccaggcacccagttaaaaagctagccgtgctgcagcggtgggtgcaagcaggctcctctcggcttgggagagccagctctgtgcatctcttcccaaatctgtttccaatgacctcacattggcagctggaaactggtcaaagtgcaagtattcgtatcgtggaaatcaccttcccaccttcctcaccaacactggagaggtgcttgttaaacacttacaagcaacacacctctggccatgcatgcatctctttcccacatcagtctaagacactccagggcagagacttatttctctaaggctgggggcctgacctagagcctggcacagagcgggaacttgtatagatcagtggcagtgacagacatctgggcacgtaacctgctcaccctgatattcagtgcccctctctctgcagctggtgtctggcctagaggtggtgggacgagtccagatgcggacgcggcggacgttaaggggacacctggccaagatttacgccatgcactgggccactgattctaagtgaggcttgggggggaaccgagaatgggagggtgagagcgggagtgaggaaggcgggaaggggaggcttgcatgatatgggatgccctctccccaggctgctggtaagtgcctcgcaaratgggaagctgatcgtgtgggacagctacaccaccaacaaggtaccagccctgcctccctgagcctccaccactgcatccttcctaagggcgccatgcctaccctcctgtgcccagctgggagcttggctccggtcccatctctgctcaaaccaccctccctgcaggtgcacgccatcccactgcgctcctcctgggtcatgacctgtgcctatgccccatcagggaactttgtggcatgtggggggctggacaacatgtgttccatctacaacctcaaatcccgtgagggcaatgtcarggtcagccgggagctttctgctcacacaggtgagggagagaccctctcctcccctcctgaggggttcagggaaccctgggcttccagtgggctgtggctctgcagccagggcactgtccttctaaccgcctccaggttatctctcctgctgccgcttcctggatgacaacaatattgtgaccagctcgggggacaccacgtggtgaggctgaacattgctggtgctggggcttgggagtgggcccggcctttctctaacrgtctccctccattttggcagtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtgtgagtgcaccccccaccccagcttcactccaactccttccccgacactccccacaacacatacaatacacatcctctgcccctcccatagcttccctagccctttcttactgtattttttttttttttttttttttttttgagacagagtctcactttgtcgcccaggctggagtgcagtggtgcaatcttggctcactgcaacctctgcctcctgggttggagcaattctcctgcttcagcctcctgagtagctgggattacaggtgtgcgccaccatgcccggctaatttttgtatttttagtagagatggggttttgccatgttggccaggctggtcttgaactcttgacctgaggtgatcctcccacctcagcttcccagagtgcagtgctgggattacagatgtgagccactgtgcccagtcttccctagccctttctttctttcctttttttggagacagagtctcacactgttgcccagtctggatgcagtggtgctatcatagctcaccgcagtctcaacctccagggttcaaccaatcctcccaccacagcctcctgagtagctgggactacagatgcgtgtgaccacgcttggctaatgttttgatttttgtgtagagatgggttcccactatgttgcccaggctgagctggaacttctgagctcaagcgatcctcctgcctcagtctcccaaaatattgggattacaggcatgagccaccacgcctagcccattttatcacgtttgctttatcattttttctctgtagagaaatagccatagatacacacacacatacacacttagatgtagatatacattttctttctgtgtcttttgaaagtaggttgcagacatcatgtttctttaccccttaagtacttcccgaaacaaagcccttctgtagcataatcactgtatgattcttaagatcaggaaactcaacattgacacaatactacagtctacagtctatattcaaatttcaccaatagcctcaaaaatgtccataatagctcatgtttttttctgtccaggatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcrggcgaggggcatagggaagtcactggcacgtggtatgtgttggcagggctgcttctcaccccaaaccaaggragggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgayctgcgggcagaccaggagctgatctgcttctcccacgagagcatcatctgcrgcatcacgtcygtggccttctccctcagtggccgcctactattcgctggctacgacgacttcaactgcaatgtctgggactccatgaagtctgagcgtgtgggtaagggccagccctggctgctgcttcctcagctggaaggaccctccccagccctccctccccattctgtaccccccatcagctcccatttcggactctcttactgctgtcccttgtcactgggtgactccacccctggaatccagtaccccttggttcccaactaggactgttttccctcagtgttgctctaagcagcctctctccactgcccaatgccatgactgctccctgccctaggagatctgtggaccatgactgtccagtcagttctgggttcctggcatttcaggggcacccactgagaggcaagacagcctcagggaaacatggaatcaaggcagaatcaaggagatctggagtggcccgagggccctgactgcagcctagggctcatctaagactagcctgaagttggtcagataggatggcttcttctctatcaagaggccaggtgctgatgaaaataacactggccaggggcagaatccaaatcctaattctgttgctcactttctgagtgtccttgcacaagtcactcctccatgggcctcagtttcttcatctggaagcaaagaaataggatgaacggttgccttctcttttccagcacctgtcaaggtgccctcgggttttttcatagtacacagatgcttccagcctttctctgtctgatcccagccctcccccaaccaaagctcttgacagagaaccccctgccctacagctaatcctctttcagtctcttagccttcttcaggggttgagcccagtctaccgagtctaggatccctgcatgcatgtgctcaagcacacatgcacacacacacgtacacacacccacacatgcatacacatgcacacatatccccccacacacccacatacacacacacacmcmcacacccacacatacacttacacgcatgcacacactgctttccaaatcagcttggagagacaggctgactcctttccctcttcctcaggcatcctctctggccacgataacagggtgagctgcctgggagtcacagctgacgggatggctgtggccacaggttcctgggacagcttcctcaaaatctkgaactgaggaggctggagaaagggaagtggaaggcagtgaacacactcagcagccccctgcccgaccccatctcattcaggtgttctcttctatattccgggtgccattcccactaagctttctyctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcacyactagggtcctggccctcttcttattcatgctttctcctttttctacctttttttctctcctaagacacctgcaataaagtgtagcaccctggtacatctgtgatgtttgccttctactctcttctgttccaaaaagacccaggtcccatttaaggscagtaatgtgttacaggtgctgtgataaaggctgggtactggatagcttgtgggcttatgggaggaggcctgagatgggtcagggggagaaggtattcagcaggtggctgggggactgtgtgcagcagttcgctatggcctgcctgtggtgcccatgtgtttgtacgggagggttagcttgagaaggaatcagattataaaaggtcttgaatgtcaagccagagagtccagactttttcctaagggcaatgagaagccattgaggagttctgagcagagtagtaacatgatcagttatgcttctcagaaagattgctccagatctttcagaaagaagcagtgtaggttgatgaaagggagggactggcactggggaaacaaggtaggaggcaggtggcaagaaatgcaagagcgacaggacagaggggttagggagagggattaggaagagattaaagatgtggaatcagctggaacagtggctcatgcctgtaatcgcagagccttggaaggctgaggcagaaggatctcttgaggtctggagtttgagacaagcctgagcaacatagtaagaccctgtatctacaaaaaaaattaaaaattacctgggcaggctgggcatggtggctcatgcctgtaatcccagcacttcaggaggctgaggcaggcagatcacttgagcctaggagtttgaaaccagcctgggcaatatggcaagacctcatctctataaaaaaaatacaaaaattagccaggcgtggtggctcatgcctataatcccagctactggagaggctgagacaggagaatcgcttgagctcaggaagttgaggctgcagtgagctgtgatcgtgccactgcactccagcctgggtgacaagagcaagaccctgcctctaaaaaacaagcaaacaaacaaaatgtggaatcaccaggatttagtgaccaaatgctaggatataggacattgggagggaaggattcgagataatggccaaggtttgggtttggtggctgggtagataatgctgtcattcacaaggatagggaagagggaatgaggaatagcttttgggggaagatcataaattcagttttagacaaactgactttgaagtacttataaagcagctggataaaggtcagggttagagagagagacctgaaagttaccagaatatagggaagtgatagctaaagccctagaagtaaacacccagggagagcagggccaaggacagagccatagggacaccatggttaaagggagatgtgcaaagaaggctcagagcatcagtgggctcaggccagggaacgcaagctctctaggccgccattctacacacagaaaactcggtgcaaggtttacatatacctttttaaagtaacatttaaaattacttcctttaatataaaagaaacacacaagacacaaagaaagcccaataaagctgtgagtcccagtttggtagctgaggaggagtctaagaaaacaagccattcctcagtatccctgggaaagaaggggtgagaggacacagatatcaccaggccctgggtgactgcattgctggggccatgcagggcctagctctccaccaagggaaagtgctgattttccttgtcatggtcctggcyttgctcccatgctcgtcctccagttttcagaagtcgtccagttccaagaatggctccttcctttagttcactaacattttcacttaggggtgaaggccgcttaccctgaaaacggcagtgtatgagttggggggagttgctgttcagaagagggaagatctgggtaaaagggtctcccaccctctacgttggatatcctagtaacagcttgcactttctcttcctttacctgtcgtagtgtcagggtgccaggggagttgtcatcctgcaggatggtgaggggggatctccctagtaccttgctgctgtttggtttccatctattgcgcatagaacctggggtgggtaaggcgttaaagcaaggacccaaaactaggacttacagtttattcctcccacactcacccatggaccttatcccaaaacattatcctagtttatcttccctgcatcttgccttagattctgtacctgaagatctgggagtctcagggtcccttgagggcttgtcggagctctggctggccacaggggtttctgtgggctgtcttgcttcctccttggaaaacacctgtttggaggggaactcagtctggttccaaggtggcatctgttcctcaacagataactgggtacccagaggcaagtccaattcagaagataaaggtgcctctgggggcagaacaggctctgggggaagatttgatttagagtcttcagtttcaaatacttcactcagctgtttcaccagtgggcttggggggtctagaggaagaaagtgaagtgaacagtgaccttctgatacacaacattcagcaaggagcaaaacatacagaaacccaggactcatgcccaggagggtgagcaagtgggaagagagaaatcaaggaaatcaaggtgaaagggagcaattttttttttttttgagatggggcttgctctgtcccccaggctggagtgcagtggcgtgatcacagttcactgcagccttgaccttgtgggctcaagcaatcctcccacttcagcctcctgagtagctgggatcacaggcccatgccaccgtgcttttgtgtgtgtgtgtgtgtgtgttatgtgtgtgtattttttctagagatggggttttgccatgttgcctaggctggtcttgaactcctgggctcaagcgatctgaccaccccggccttccaacgtgctgggattacaggcatgagccaccgcacccaggctgggaacaaaatattgagataagagtgagatgggtccgaagcaggaggatagaggcccctttaaggaaccctgagagaatggcttcatggaccctacccaagaataatagatgacagcttcatcagcattccctgggcccaacgcttacctccactgctggtcttcataggtgtccgtgcaataccaagagtaggagagcggggatctgagtcctgggcatgtttaagaccctccagttgctcccctgctggtaggcctggctgtggagagctctccacctgtcaagaccataggctagaacragtctgggccctgactcttctctcctctcctccccatattccaggaaggaattgccaaggccctcagatatccagcctaccccacacagattgagattgcagaaaataaggctaggataagggtggggtcatgacggctctctcaaaatcaggttaggaagagacccaagaattcagacattctctgcctttcccacgctggcccagagtacctggatgggagtgcgcaggatgccagcactaggtgaacgggggtccgccactcgagccagatgcttgttgtgcggcggaggccgcgctggtgtgactgggacgctcttggctgagcccatctcaaccaggagttgcagggtgggggcaagggccagcccgggacgaggagggaatgcctgtgagaagtgactcaggtctcagcccttatctcttccacgtcggaccttcaaccctaaaccaccctgtcttcccagtttccagtgaagaaacttcctggcgagggaccagaggcctctgcggagttaatgactgctgcagctgacaaaatggctcgttctgggcctgctgagccctctaacttatttattaaattattcaaatcacttaccgggccccaattccacctctggatgcacaacagctcgtggctcaactcccgaagttaccagtttcaaacttcccgccacgccccctgccctgaccctattggctgagccgacgtagttcccataggccctccacgtaagacccgcctcgagccaaaggaagctgttggtctgggagaacgtctatcatggtgactgtaggtgtcaatggactgatgctaggcttgcccaggggtgacgcctccttgataagggtacttctgttcagtatcggcctgcgagccgtccgtggcaggctgaggagtgccagtcttcgctttcgagacgtctagtctcaagaacgaattattaaacaaaatagaatcatgagtgattacactattatgcgcacatccagctggagttgtgatggttttcctgaggcgagcgatagtagctttattggttgacagctgtatcagtcactcgacacaaccccctcaagctccgcctcactggataccccctttacaaataccaagacaactgtccctcgactttccgaccggacaggtccccaggaaactttctggaattgagaggcctaaaacaaccgtcagttcctgctcttcaatagaaggcacgcgaatggactctaagggtcccggagccggagcagctgcggagccgcagcagctgcaaccccgaagcccacctagctgctctacgtgcgctcccgccctggaggagtgggattggttctttcaaccatcaattgccttaggagcgcttctcattggcgtcagtcaagcgcggggcaggggcggagcaccggcaggcaggctccgtccaactgccattctcgcgcgtcgtctccgcggcgcatgcccctaacgagtggcgctcattggacgggaggggcaggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggtaagcccattccccacgcccgcaacgagcacgacttccttccatcgccctggtcattccgctggggcctgcaaggcttgggctaccgcctccctgcgatgcaccatgggacttgtagtctcccacgctccactctgccgttgcctttcattaactrcggctgtcgtgtgactaccgtccccggaagccgccgcgctcacctctccggctccccgcttcgtgragcactgtgggcattgtagtcactcactgccttcgttgccgttctaagctaggggcgcagcccgaccgtcggactacatcccccaagtggacccttgagaaaacctggcagtcggccttgtctgccgcgcacggctctccgggttttgtagtctcgtgtaggagtgatggggacgactccccactgttctcggccggggttggagttggggggtggggaccgcagttcctaggcggttaatagtctgggagtggactctcaagaagtccgattctgagaaaggcagagagcctccaccccgtggttaaaacagacagggggcggggaggggaggaaagaggagaggaaagctctagtcgtttctcctttgaagtgagcaatggccgcagcccccacccttccccccgccccccagcctatcacagacagctgagataaccccttttaaagtattcctagagaggtggtttctttctcggaggatgctaaggcctctttcccatcccgctcccactcttggctagttacacaaagccacctcccacaccatgcttcacgttttgcaggctccacctggtacctcccttcctgcagttctgccttccctatgtcaccctcaagcsgaggccctttggggcctgaactgagaaggcagcagcttggttgggatccgcccccctcaccacccctcccctcaagctgctgtgccctgcccagtgtattctgccagaaccagctcatggcctgaaaactgcaagtcagagtggaaagccttcattactgcatcaccagtactgagtagaacagcatgatgtgaggcccagttcaggatcatcactgtgatttgtggtttgcttggtttgctaggctttgatctgggcctcagacaatgtgctgcttctctgaagtctggctttggcagaggtaaaagagcactgcgcggagcagagctccggggttcccaatccttggtgaaatcagcatctttaatttccaacagaggagtttaatcacttcagagctcccacattcttcccaggagggaaaggtttttcttaaattaccagcaggtggtagaagtcagtgggtccctctttacacttttattcactcctgtctctctccttagtaactgctttgaataatccaaaaaggg

SEQ ID NO: 17716 - DNA, 77922 bp, Homo sapiens
  misc_feature (1)...(77922): n = A,T,C or G, or insertion/deletion polymorphism (see Tables 1-2)
aatgggttcaggagcaaattagagtctgtggtttgtgtaacattagagttaaaggaacaggtcttttccttgaattattttttgttatatagcattcacttcagttactaatgaagtgtattaatgaagccataatgcaaatgaaaccataggctggggcagcaagctttagtattttgctgtgcaaaatgtggcacaacttcatatcacctgggaatctgttgaaaatgccaactgttgatgctgtccccagacttagaatctgctttctaaagagttgcccaggagattcatgtgcacattaaattataagaagcacagtttagcatctgtgaaagtttccttccagatgttctaggcagattagatgtcaagcacaccttggtaggccctatcatgatataaaattggctctttttactaattttcacttgcctttccatgatcctaagttttgtgactccttggagtttttatttctcattttatccaattcctaatatgaacttacatttagttaagtacatcttgcaagtcctgacctgacatgctcttgacccatcttaatctccctgtcaacttttcatattaacaatgtcacttctctcttacttgctacccatacttcctcttattcatctcttttctgtaagatggtttagaaagagtcattcagttcttcctcagtattccatgtggtcttgcttcagcctcattatagggttgtctggtgttctgaaattgagttaagtcatgtccagatcttctgtctcatgcttgcttgtcaggctcagaaatgcacagaggttattgcaaactaaatcatgactttcccaaggctttctcttgcttacttctttttgaagttttgattgtttcctttataactaggtttggtagattgaggattctttgagttctttttaaatatgagctcaataccaggttcttggcaatcattgcctattcttgctttcagaaggctttccaaattgtgtgtcgtgattctttgcctctccttctattacctgtggagaaccattagagatcaggaagtgactaagagagccaatctttcttcctacctggtcagaagctcttcttatatcataaacagaaggcttttgctacctgttttttgttttttaggctccaagatagcaattatatcaccatcaggagcttctctgtgactactcttctgcattgattgtaacaagtgatcctgaggtaatgaaggggaaggcactgttgacctctcagctattattaaccaagcactctttaacttctgagatactttaggtagagaattgttaacatgtggatcaccagtcccatcagagtccctggcacagaataagtactgaaaaggaaggagaagtaagagtgggaaggaaggatggaaataatctatccaactccaggtgagatggagagcctggaaattaactacaaccaaatagatttggaaagacaagttgggagaaaagaatggaagtactatctcatctttgtcttccttgatatatagtaaggaatacacaaaccatcctattaaaagtgacttactgaatttccttttagaaataaagacagtggactttgtcttaagaggtactccaattatttcttagttttctaagaaaaaggagttctctttcatttctgactttgtagactcctgctttgttacccatctcccaccaattccaagactacacatctactgagtgaagtttttgtgcctcctaatactgatgagcctcgtattaatttttgaacctatcttcataaagatgtgggcaaagaacaagctttataactgtggcataggtagaaaactgtgaatattaaacagctcatctataaggagtgcaatacccatattttgaaagcaaaaatccttccttctaggttgtattaatacattttgctttaagtttggtcatgttgttaggtagtgatccttaaggaataagatttgttcactattcagtctgaaatgttcttgccattactaaatataaatggggtcaaatgagccagagaagtgtgatattcatatcacagctgattggggttgtatgaaaaaataagataaccccaggaataagtgctactgagatgaaaattgtgacacatacagtgcttggcatctatcttaacaaatgaaattatggcaatctttacttacattagacactggatttctgcagatggaaaaaaattatgtaagtgagtggatggagataaaaggttggagagttgatagtgcaccaagagaagagaattgtctatcagatcactgagaaatccaaagtgggaataggtatatatagatatatggcaaacaccatatcttcaccactctccctagctccctatatcaacccttattatttagcaactcttgtccatcattttggtccctgagttggaggttttagtaatggttccaagaaataagagcactggttaaacatatttcttgggaaatatcttcagtacaatcatgtgtctaaatgatttcaaactaatcagtcattcatgttctgaatcctcaggcacctacaccaacaattcagggtatcccactgtaagatataattttcagaataaagatccagcagaggagtagctgatagtttctatacagaccacaaactgttgacaaaagagtcagaaaaatatatcacattgatggcaatggggaataatatgttcatatacagtggtcatctccttatgtcttttcaagattgcagatctgtgctagtcattgaatttgtcagtaggcaaggaaagttattaacagcattatggattccattctcaaaaaaccagttttgtccacaaagcctgtaccccaagacctctgagaatggtatgtaccagctgtcccagtcttagggcagcatctgctggctaattcatggatggacaaaaagtggcagtttgtgggcaatttgagcagtcctttcatttggcgagaactgttgtgttgatgactgtgagggtttctgaaatcctttcataaggacccatctcaggtctccaggagcctggcaaatctagaactactcctaatgagaaccaggaagcttttgtatacagatattttatctggagcctaagataagcctgtttgactttggaaacatttctagagaagcatgaactcaacactagacttactgctaataataataacccagtaccaatgggggctgcaatgaacagaggtccatgcacataattgggaagtaaaacttattttccataaggaaggcatttctgggatgggagagggaggaccttgaagcagccactgaatgcttatgttctgttgcttctaatcatcctatcgtgtaagtaagatttttctacataagcaagcaagaatgatattcaaacaaagcacttttgactggaataaagaaactggaaattggaaagggctgggtggtctgaaacttaagagctatccaccatcttctgcagcatcgctgtgcctcatccctgcagtcaatagcgccacggccagggcctgtgacgccgttggtgggctccccttggtgggaactcagagcgagtaaaatcatggtgtcagtgccaaaacgacgaaacctgaaatgcgtctggggacttcccagggcactagcgctcctcagagcgacggacatctccataacaactggtctacattcatccctggttcttctgctctgctgtgctagcgatggctgagggtaggcaaagggcagcttcagtggaaagataccttgcgttagcgcctccctaggctgggggacgttgccaaagctcgagttattgcctatttcccgagatttccggagtcgtccccacatctcccgcggagagcggcgcccctccgccccccctcccgcctccccctctattagacactccaagggggtagtttgtttcattgtgctttttttcctcttctcaaagttcatcctttcgcctccaagttactttccgccaacacgtgacctcttcgcttcccagcttgcgcagccactggtggggaagcgcgggcgctaaccgcagggcttcctgggagagccccctccgaggttcgccaccccagccctggctcccgccgcgctcaccccggcaccccggcggcggggcagcccccgcaggatgaggaagcggctccggggaagcagcaccgagcagcagcggagcgcccaacctgccgcctcccctcccgtccctgccttggcccgcggctccgctctccgcggctcgccttccgacttagctgcgcaccggggctgttaactcacatttgggaagccataacccattagagcaaacgcagtcataacttcattcaactcagccgctcgagagctcggcttacacaggttcctgtgggcaactagtggctcgccttggtgcctctcgcctagtcatcagtacctaagaggaaaagggaaagttgttgggctggttcgcgcttcgacgcatgcagatgttcccaaggacaagtcacttactcgcccccctccccccagtccccatttgatcatcactcacgacctcatcggctggagacccttagtcatgatgggggagggggaggggcacgaacttttctaagaagtttcctttttttacccagagagtcacagtgagtcggtcacgtaaacagcgaggttagtcgtcgccgttgccgccccccaccccctccctgctgcgcttttctggtattattattaaagcggtagtctgccggcgctgataagcaacaagttccccagcggtcttcccgccctagcctgacaaggcgaaggttttcttacctggcgacagggaaatctcccgagccgaattcagcttcgccggagccccaggtgtgacctgcgtagtgggcaagggagcggtgtgcaggctgagtttttttttttacaggggtaccctgaaactcctcactttctctgggaactttcagtgccaggacccagtaacgggcggttagaaggcagccctaggaaacacctgctacatagcagggcagttgggcaatcattggtaacctcgctcattcattagaatcacgtaagaactcaaaaggaaacgtgtctctcggagtgagggcgtttgcgtaaatctataggtttttcgacatcgatgccagttgctttgtcttctgtagtcgccaaggtggttgagagtttaagcttgcggatattgcaaagggttattagattcataagtcacaccaagtggtgggcgatccactgagcaaagccgaacttctcacatgatgacttcaaacaagacacattaccttccagcatctgttggggagacgagattttaagacacttgagtctccaggacagcaaaggcacaatggtgagtagcaataaaacctgcattataattgaaaaatcttgacatgttgcttaacaacgggcatatcacggctcttcctagcacttcacacgccaaagaacagcagctactcaggccaggggaatcgggtttttacacagtgcaactttaattggaatcatttgagatttgacacagctatgtggaactgcgtggaacaaacttggagctgggtgggggggtgtgtgttatattggttgttcaaggctgatgcttgtctctcagcagtcttgcattctattcttttccttaatgtgtatggtgtatgatcatattctatgatttatatgtgggcatgtaattgacatttgcaagggggttaatttccatctaaaaacaataatgctgttagaggttggggttagggggtggagtgggggtaagggtggggtaaacactgggagtttaggtgtagatggggggtggggttggggggagagaaataagtcagaagtgcatatcaccggtaatgggtaatcctctcgtagaagaaaaggttctcatcaacatgtgatcaactattaacaggatggctttggcaaagccatccgcacgtgacaaaccgtaaggaagtggaagaaaccgtctagagcaatatcaagtatcacttaattagagatttttaagccttttcctcctgctgtgccgggtgtgtaatccgggcgataggagtccattcagcaccttggacagagccaacggatttgtccgaggtggcggtacccccaggtagtcttcttggccccgctgtaaagccaaccctgtgtcgcccttaaaaagcgtcttttctgaggttcggctcacactgagatcggggctggagagagagtcagattttggagcggagcgtttggaaagcgagccccagtttggtcccctcattgagctcgctgaagttggcttcctagcggtgtaggctggaatagactcttggcaagctccgggttggtatactgggttaactttgggaaatgcaagtgtttatctccaggatctagccaccggggtggtgtaagccgcaaagaaggtaagcaccagggcggggaccccttgcatccccaattcttgagctattttgatactgtcttccggagaggacgcgtggtggaggggaggaggtagagggagagcatgagagggggttgtttcttggtatttgcccagtttgaattgccctaggtgagaaccctggggcaaagggagaaagaaaaaaaagaaactcagtcttcctgcggatataatgagtttagttaacttggacctgcaaatgtctgattcaaatgtaagatttatctctctttttctcctcttcacctccctcttttccgttctctttgctggtgtgtgtgtgtgtgtgtacagtagattcattactaattatgaagcttttgcaaaacattcgaattcctaaaatttgactttgtagcatttagaatcaggcggtggaggtggtgtgcggtggggagaggaggtggaggttgggaagagggaaggaggtaaagctaaacctccaacacaaaaaaatgaatcaaggtaatttcagctcttctagtgagaaggattcattctctctgtatccctccctccctctcttttcccctccctccctccttcccgccccccttcttccaccccgccccctcctccagcctccatccctccctcattctatctcttcctctccgtcgccctcgctcctcgctggatgcttctttctgggttttcttttttttttcccttctgtcctccctccccgcgagtttcgggcgctggcttagagggttcccgctttctcaagggaaggggagctgccgagaccgcgctccgytccccagccgggccggatgcctcactgagcccaggtccgagtcagtcggggtaactcagggaaaggggagcctccgcctgggagtagaaggtcctttccggaccgaagagccagagagcgggccgggcgagggggcctgggcggctggaggcggtggagaagaacacttttagctccgtgcggcggctggacagagccaccaatcagctggacgcgcagaccgccctgccagggcgaggttgcgtccggaggcgccggtggagggcggccggctagtcgctgagccgccgccgccacccgggtgggcaggggactggcggtgggtggaggtgaggggcttggcgggtgagatagaagcggcgcggagccgcccagacctgtgttctacctctcccgcccccgcctgcacccccgggggacagcgaactgccggaacgcgcggctgcgttatcctcttgccactcttcagggagctcagggacttaggcgcccctgggcgggggccaccaggctctccacactcctataaccctcacccccacccccttctcaggccttttgttccggccacagagccaagcccggtggcagttttcgccccagggtttggtcgttctggactcctcccccgatcagctcttcttaattaaaaggcaagagcttggggtaggggtgaggggaacgtaggaaaaatctgtttccgaaactcaagaccactgttttaacgaacgaaagaaagaatcccaactctgcgcaggtggattcataggcgaagcgaggatattgtggaaattcagaaggaaaagataaaaaacaggcgctaggatcagatgacggtgataggctgctcggcacacaaagggagcgtagggcagggtttacggagcaagcctgcagcgaatggggcacagattgttccgagatccagtcgttttctcagtcagatctacgcgaagggaggggaggggaggggcgggcaggggagcgtggcgggaggggctgagcttgggggcggggggatttctgatcagtctgatgcaattccaagcgtgctgcaaaggaactccaaggcgcccgcatcaccatcgccacccacccttcccagatggtgctgttttaaatacggatctgcagggctgaacrcagaactgggagatttattgcaaaatcccgggaggggcgggggggggtggtgtgcggaacggggaatggaggagcagaatttaaaggtgcaacgcttgctttttccaatcaggcggcaaccggccggaattattatttttttctttctgtctgcttgtctctggattctaattcaccaagaaagaggtgtaaatattgtgacattttgaggcagcttgatggatgggaaagaaatcatctgtcactctaaattgcagagttccctctccccgcgccatcccttgctagcgaatactcgctgctgcctaatacagttgctagggcttcaaatgaatgcatcgttaagggaatattatccttttagttgacttgccaatttagttgacagttgaatcgagaaaattgtagatttcgtgtctctgggaggaaaaatgcttaacagtctaagtcttgtaaccttgaggtctttaacaacttaaataaacctcaaaagtgtcacgtcatcctctacacacacacacacacacacacacacacacactcaacttgtaagatgacatggtttcacctaaactgttgtggaaatgaatagcactttaaaaatggtgcacctgatattcactgtttatgtgtatttacaaagagctcttcagcatgaaggcaagacatttcaattgtcctgtttggaatcagtcagaagactagaaggtgatggagagaagaagggaagaaagaggaaagagagagaattttaacctagatgctattaaattaacagtaacctagcctacttttataccccttggtcttgcatattaatatttctgtatgtgagattttagcttggtctagctcccccaatggagtataccagtattgattcagatgagaatatgagcatcctgccagtagctttttcagtgtcattgatagtaagacctacaacacagcaatttttggaggatagaagagaatatatataagggctttgcaaactgggaagcaggcactccataaatgggaggtatcattatgacattctctttgcacatatcattttcatttcactgaaccagagtactagttattttaaaacataatctaatgtatatgctcaaggtagtaagtggggattttaaaagcaagtgattagttggcttataaaatattatttttcaattgtctattaatgtacattggaaagaaggcttttaaagatctaaaatcaacataaataagcttcccctttcatttgccagactctttccctatcagatttctgatctaaattcttaataagaagagaagctggtgaatttagtttctttccttttcctggcctgtcctctaggggaagctttagtaagaaacaacattccaaaatcaggcagtgagcgagagagaaggcaagggactggatgaccacaaaatagataatcagccaagaaacagaaatgagggaaaaccagcattaaagcatgacttacaaagggtttttattttgtaattctgtaattttgggaccaggctcaaacttgctcaagtaacattcactcgatcatattgcttacaatctgtcagttaaaatgatgtctaactgagcatattttttattaaatatacttctctcaaaggccagtaaagctactctttggttttaattagacaaactagtctaaccacttaaataactctaatgaatatgaactgatatcatcagatttaaaagctctgctgaaaactaaatttattctgaaaagcactgacttgccagaaaaatatctatttttgcagctttcttttcactctatggataatttaatgagttgcttattttaattttacaactgctacctcagaagtatctcaaattatctttctttggctggtgtctttctctgctgatctgctactgckgtgtgtgtgtgtgtgtgtgtgtgtgtgtgtgtgtctgtgtgtgtgtgtgtatgggcgtgtgtgtctctgtgtgtgttttctagtgggaatttaacaagcagtgagtctcttaaatttacatgccataatctatgtcaagaacattgcgtactacttagcaataaaaataaacattagcatctagtgaaagcttaccatcattgagtgctatggaaatagaggtcttaaagaaagattaaatttttcaacaaaaaaatttttcccctttttggcttaaaggtgattataatttcaaaaatatgacatctttcctcttttactttggaatgtagagctgctgctttaacaagtgtcttttgagaaagatacacgtgtttcataaagattaatacccttaaaacactatggtgcagagagggaaggatgaattctttaaccctgcctctaatctcatttggcaatttttggagtattcattctgactttttaaaaattcaggtggattttttttctgctttctttccaacattataaaacaatcctataagagatttttctgctatagtgcagactttatttgtatttcctagtaataacactttagattcatatagtactttgacagctctctataggtttcatttgatttccttatcagtcatgtaaggtaggaatcaccaatcaccttttacagatgaggaaagtaaggtgcagaattatctaacactacactgccagtaagatgtaaagactaactcagagtctttcttcaaattttaaggaaatttgtgtttgttcctctctagaccatgctgccttaaactccactagggcatcagagggagctgtaggcattattttctcctattttgatttatttaattaaattaaaaacattttttacaaatagttttyaaaatttcaggcctaatggaaagttttaactagtcttcctaagacagtatttccctctcccacagttagacactcaaagaaagcaggactcttcctctagttgacataccatctaagtcatagttgctaattccccaaaaaacaaatacaaagaataagaagaaccaaagccaagatgtacattacctttacttgtgaatcatagaatctgggttctgggaaggttctcagaggtcacttagcccagctcatatctgatacatgaattcatgctggcttgttttgtttcaatcctctggaatttcatcccagtcttggacactgggtacttgtttatcttggtagatgttctgatacttatgtggatcatgagcttggctgatcatttcccattttgcccaaaaggtatactttctatagagactctagcattcataattttattttgtaagtattaattggcaacacataatttgccattatgtgccaggaactgtattacaatctggagattcaagaacaagcaagaccaaatggtccctatcttggtggatcttgtggcctagagacaaagactggtctctttatttgctccaatccttagaaggggacagacctctggactcataagattccttttttcaagagaacacagtgaataagattaaaagcctgagtttaggctttacttccaaccgcttgtcagtacccaaaaaagtcaatcagtcactcttgatctctgcttcctcacacataaaacaaaagagatgttctcagaataaactctaaattccacttccgttccaagtttgagtgatataaaagatatagtctataactatttcttgcagtgtaggggaaattaaggcctaagttaccctaacctttggtgatttacaattctgggtgggtaccgcaaatttttaacttgttaagaagtatatcatgaaaaaaatcaaagtaacatatttgaacccagaatagaaggaatctaggtgttgaacctgttcatttatggaatgatggctaggaaagttttaatttagagaatgatctcaaatttctgcggattatttttaaaagcaggtggtgcgatggaagacctgctatcaaatttactgcttattttctttgtgcaagcagaagttataatttttcaggtcatttccttttaaaatcaaaaatattacatcctgaaattgcctgggtctcatgaataatgcattatatacacatgataatagataattagatggacaagccaaaagaaacatgaaaggaagcaggtagcccaaggattgcagaaggtgtgtgggcattttgacatccaggaaatgctatagatctgtccttaactaactcagcctggtggagataattaagaaaaaaaatgtgggtgtagaaagactgcaagccattccctgggattggctagattgctgcagtagttcaaaaacaattggcacagccacccacactagacatgattgccctttgatgaggcagctattgacttttataaagatgtcatatttaaaataacttctgatgcactaggcataacagacatcattcttgaattctattttagacaaatggcaaaatgtattacaaagtattaatttaaaaataaaaaatctttaaagtctagtgtctaaaaaccagcagtttagtaacatgcaacctctggatttaagaattcagcctgaagctgggagaaagctgtagcttgtataggacattttgatccactctgggcatttcccagaccactacaggaagtaaaatgtactttgtcaaagtttttaacctttgagtgaatgttaaatccactccaaaatcttcgcaacctgggaaaggtgatccaacaattttcctaaatagcggcagaaaatgctctgagatctttgttcccagagtgaatgttataatgttatgctatctagaaatttccttgtagcaccatgctcatcagtaccaaaaggagttagaattgattcctcccgcttcaaggaaatatatcaaccacctcctgtctctaagtaacaaggttactgtggggaaaaaatacacaaattaggtgattgcagaaaggtgtcacaaacatccaaagcctttgggatagggcattgcagtgtgagtgaatagagaaaagaaagagaatgtgggaaaaaattgagaaataaaaagggaagtcacagtggagttctaattatacaggggctcttgaattgactgttctctaccttccatgctcattgttgttctggctactttagtaggaaacaatgatttcttctgctttcaccttcctcctccgctaaggacttcttacttgccaataacttccataatcaatgtttaagaattgctctgatgcccagtgtggtggctaacgcctgtaatcccaacactttgggaggccgaggtgagtggatcacttgaggtcaggagttccagaccagcctggccaacatggcaaaaccctgtctctactaaaaatacaaaaaattagtggttcatgcctgtaatctcagctacttgggaggctgaggtaggagactaacttgaaccatggagacagaggctgtagtaagccgagatcatgccattgcactccagcctggcaaaaaaaaaaaaaaaaraaagaaagaaagaaagaaagaattgctcactgtaatgactttcatgccatggactcarctctcttggcagtctggtaaagcttatgtaaacccttctcataaaaatgtctaaatggggccaggcgcgacggctcacacctgtaatctcagcactttgggaggccaaggcgggtggatcacttgaggtcaggagttccagaccagcctggccaacatggcaaaaccctgtctttaccaaaaaaaaaaaattagctgggcgtggtggcatgtacctttaatcccagctacttggaaggctgaggcacgagaatcacttgaatctgggaggtggaggttgcagtgagccgagattagccactgcactccagcctggatgacacagtgagactttgtctcaaaaaaaaaaaaaaattctaagtgaatgaaataaatgtataagattacaaaggaagccagtggcattgatgtacagttataaaaacatttaaaataatatattgtgtgatatagtaatatatatgctttttaatacattaaataagatctaacagcaaggtaaatattataattttgaaataatgataagtatcaatgtattttgaaatatctataaaactgacgtgatatgaaggtgtctgtgatgtatactggtgagaaagcatgcaagtactactgtgtaacatttcccacacatatttaacaacagaacacttgagaagcacttattaacacagcatagattcagaaatattaatttagtaaatgtcaacattagccattgttgtttccttcctggcaaaaggaaatcagcattgggagaaaacttttaaaattcacatttgccattagacaagctgtcaagtggggaaaggaccaaatactgagaaggccagggtatggtaagcatgtttctattgactgagcttgctattactctaacgtttatctttagcatcaccagcacaaccccattaccctagcaatccatcactccattgaaaaagataaaaagttcagattctggtcattaactcagcattgcttaagatacctgttctgacctcactaacccaagagattactgaaactcttcctgtttgtcattactacaccatgggaaattataatgatgtgggatgacatttactctgcattcatccagtgctgttatttgttttgtatttggcatatattacttaactcttaaagtaactctcagagatagattaagaaaactagagctcagagaatttaagtaacttgcccaaactaacacagaaaatctgaagtggagaagctaaacttcaaacccaaagttttctggttccaaagtccattatgaagttgtgcctccccatcttatagctaccacccagatttaatctgggtctcccattatcagatggtttacatacacattttcttacaagatcttgaccacaactctttgagatggccatgagtctcacaattcatttccaggagtgctactttagaatcattttgatctttgctaaccgatgagagattttcaaatagctaattgtcacctaccctttttgaagcccagttttcataatcataaaatggaaacagtattacaatgttttgttaggatcatatacattaataataaaatctaactttgttgagctcactatggtgagcattctgcatttccttagttcattgaatcctcacaacaatctttctaggctaagacgattatttttcttttaaagataaggaaactgaggcatcagtaattaattaactatcttaaattagcagagccaataagtggcaaagctgggttcaaacctaggtctgtctaatgtcaaagccctttttttaatcactaatctgcaaatcactattcaatcttagcttttattattataattatcatcacacttaaaacactatcaagatacagaatgatccagacataagtatatagtcactgaagagattagaatctgaaacttttcacctgcatgttcttccttccactttagtttattaacccaatggatgatgtctgactcctttcttaacttgtttagggcagttccaagttagttgacttctgagagttattgagtaagaaatgttataaattgtttggattaggatttagtatgtttagaagctatttcataagtttgcctttgcgaactgttactggctataatactgcagatgctgtgatgaggaacaccctctccaaagacacacagtggatgacaaacctccaaagctaacatgttgtttacagatatggagaagaagaggatggacaagcacagtctaaaacgtaattacaaggcttatagtccctgttggggactagaatgtttattggctttccttgtgcaattcaatgctcttcctccaaaggatccactccaaacttggaactttcctgaaaatagcatctcatttgggagcatgccaggaattggtgtctgggtcctttgtgtctttgcaccaaytcagaactctggatactagctctagaaactaagctgggatatattctgggtaagggagtagcatatctacttgggcatcttcctgatacatttatttcatccatcttcctcctagagagcacctcctagaaagatgtggttttaaatgagggattggatgcatactggtatgtcttagcacacaagtcagtggtctttgcagagctgccaaaggcatataagtaatcaaagatgcggaagtctatgaagagacttcatcccacctccactctgatttattcagggaaggaccccatgaacacataatggatttgatacgtcccagagctctgaaagcagcctagcaaaaaaggataatcttgaaggacattttgatgtatgaaaaagtccacctaaagctttgtcagagataactaagtaatatgatggctggtagactgtaagtccttaccttggctcaggaactgtatatcatttggtaaactaaacttgtcgttcaaatttagatagaaaaagtaccttacaaatgatctagttcactgattcccttcatgcattgaaatcacctaaatcatctcttctttctgagataaggtctgaatgtgttgccagctttagcaaactcagtttgtagcccactgacctcatttgattgattgggcaactgaggtgcacagtggtagatctctcaatttattcaataaacaattatatggcccttacgatatctatctgaacaatcttgggctagtgaagttgcttgcccaggttacatggccagaaactgacagttttaaattaggaccaaagttcttttgactactatctgggccttaaaataatatcatatgacaaagatatttcttctgtttcctaatagtcacatcaaaaggaaacaatggacagtttgtgcaagattttagttactttaatgttcaaaataaaattaaaaacagattattactaaaacataagcataacaacactttaatagcattctaatcagatattattaatttcaaaatggtaggacaaaactaattatactttatacttcttaaatatcctatagttactttatgactattgagacactagctaaaacttgaaacttcaagttttcattgattcctatattattacttatttcagagttacttcatttggttcttttatctgagattggacaacagctttatttgattttcagcgacaaaattcttttcactcctgatcctccaccccaagaaaacaacagctactaatatattttccctaaagtgatcaagaaataaaagaggaattctagccaggcgcggtggctcatgcctgtaatcccagctctttgggaggctgaggcgggtggatcacctgaggtcaggagttcgagaccagcctggccaacatggtgaaactccgtctctacyaaaacttaaaaaatgagccaagtgtggtggcgcatgcctgtaatcccagctacttgggaggctgaggcaggagaattgcttgaacccaggaggcagaggttgcagtgagccaagattgcgccattgcactccagtctgggtgacagagtgagactctgtatcaaaaaaaaaaaaaaaaaaaaaagaggaattctaaaattaattatatctattaatatccctactcttaaaacgttagaaaatgtttgctcatttaaaatttttatttttaaaaccaccttatattccaactaaatactctttggagcaatttctttgttcctcatataatatccatacatataattctgcttttgtgattaacttttattactactcttctaaaattgtgctcttataaacatcagttaattaaagagtaaatctgatgttttataaattctttctagaaacagagagcaaaatcatataaataacaatatgaatttccaaaagtacaataataaaaaaaaattagaaaaaaattaatctaggaaatagtcaagaatatgtcaaacttgtacatacttttgagataaattggcatcatgtagattagcatgattcttctttatggaattcaacttatttttactcactttgctctaattagtttttgtgtgcggacaagatggaaggtaatggaaatttggcttgcaaagtagttctaacatgatctacatccacaatctggttataatgctataagaatattatgtgggaatagtagttcaaatcagtatttagtatgaacataaagggacaaacaatgcaaagctaacttaagttgtttacacttggaacttatttaaattaaaaaggccagtggatggtcatatgtttggctcattcttctcaaggccttcaggaaaacatgcctatgaaataaaagatcctcaatattaaacattttactgcatttgggggacacatgaaatctggtaataaaggaagtgttggtcttcatttttctaattcagcatggaaactatcttgaggaaaactgactatggtcttagtttgtgtctcagaaatatatttagtctgaatcatggcgtcgacatctgacttccaaaattggatatctagccgtatagtacctcacctcccacacacaccaccccccattcccaggtcatgactactgtccaagcagcaaaaaaagaagtaatttcccagagtacatacatggcagtgactaccaaccaaacaaaaaacaattataggggctggaatttaaattaatggctgtactctcaccaattcattccccattccaccccatctctctgtcttcaacttttatgaaacattatatttgtcctattcttctgtatcagcatcagcctttcctatatccaactagacttataacttcttggtgcctctcactggctgactaaggtttcagaagtacctacttacagcaaacacttgcagcagtctctttttggttacaaagtccctggacaatttctcaaggcgatattatgaagaggaagtaaacattctcctctgctaccccatttctttttagagtgctaactttattctatatctggtttaatgtcttcttaggccaattggactgattttacagacaccatagaatatctcctgagtaatgggaacaatatttctgctgatcccatgatttggtctcattgggttgttaggccataatggagacatacttgatgaatttatgaagacttgattctaggtatcatgtaggttagcataattctcttttactgaattcaacttagttttattcactttattctaactggattttgtgtgcagaccaaatgaaaagaaatggttcaatttaggtgaaaggtaaagcttcaaaagtagtgtagtatttcatagaccttacctttgagagaaattatatcagtatataataagcacctgagaatatgaaagcacaaatccaatttaaatgtgaaaggtctacaacttgggattttaaakggagtacagaaaagccactgtttcttaaacaattttgttgagggggaaaacagtgaaagctaaatgttctattcaagagttgtttcttttgaaaataatgcttcatttaaaagctaaggacagaagacgtagctttgttatgaaggctcatctttttattaaacaaccactactttgtctccaagttgcaaagggaagatttgtcaatctgattgaatcttccctttagtttttcccaacagctgtgtccagataattcatgactcctgtgtttcctgagccctggataatttcacacacatgtctggtttggggctccacattttcagaaaaatatagaaatcttggaggaggtccagggtagaccaagggaaatgattaatgggttgaaagttggagtttatgaagaaaggttgtgagatctgatcttttgctacgagaaaagtctgagtggtgacttaataacataaggaggttagtaagcagctgttctccatcttcactaaggttgaatgaaatgaaataagatataaattgcaacaggaacaaaaatgcattacaagtgaggacttccaagcaccagcattgctggattctagatagctccccaaaagaaggatgtgtagtctacttccctggtctgcaatgacaggcctataaatagtgagaaagatgagataatctcttaagatcccttctggacctatcttttataggtctatctatcatatttagaaaaattatttgcctcaaacaaaaattatctgatttcctccctctcaccctatccactccttctcttttgtctaccttttgtaaaacactgctaaccgaaataactggggactgattaaccgtggtgggccctcccccgcctctaagtgccactccagctttgggagcaagtttcttgtccatcactaccaccccctggccactaggggcatgtttaccatcatctttctacacaccaaacctacggcaagggaaaataaaacaaaacaaaacttcctagacttaacaaatttgcaagtgtcaccatggattaaaatacaactcttatgtcctagaatatgagcatgtaaagggctaaaatgtattttatgcatctgcctgtatcagcccatagaatagcctcctgacagatagtagatactcagcaatctttcatcaactgaatgactgtaactatgaagtgaaaggcaactaaagttgagaaagtcaggagtttcggatgtttccaaatgattctgtatgccagactaatctaaagcctaacccattcttcacaaccatgcactattaaggatttcattctcaccatgcctgtgctatctggaggtagaaagagggccagttgcacatcctgctcaagtccttggtcaaaaagaccactaaagagtgctttgtagattcatgtatcagaatcacatgaaagtaggccaaattcttagtgtgtgtttttaaaataagactttaggaagttcacttatttttttctaaattatttttgcatattcttctttttcatttttttcatgaagaatttaaaatttggctgtagaaaatctctcactccaaacatcacacagcctaaataggtgagtctcaaaaataagctaaygttcatctttcatctgattcaatgtcctgaaaccctttggtttaaatttgttaattcttctcatggcttttctcctagcaaaaccaactaataccacagctatttattactgtcagctctaacttatgcccacaatctcacatcccttttgaccacgcttatagaactattacaacaagtaaaccaaatttattcttcattattaatttttaaatgttctcagcacaaatctggtaacttggagggctacaagttgatatttctcatatgtttgggggtttagtctcaacagtttcttaatggtttctatgccgtttttcttgatccaactaaatattattcccagatgggatcagcttttgaccctcttgttctactctcctagtcttggcccttctaaaagtttcttgctgtggttcctttcttttgtctgccactaatggctatgcctggttacataactcctgtaacaggtgttgaccaatttgaacacattttggtatggtattgagctattcttatggttcataaaaagcttagtgagaacgtaacatctcatgaatagggaaattacttctcccttaaggtttttctcaggacaggcctcatacaagaatttcaaggattgcgagtgacatagtttaacattggaccaggcctttcaaattatccaggatgagtttgaaaacacctgtgccactctgctcaacagcagagttttctgtttactaagtattttccctatgctaattacggaaagtttcaacagtttttttaggccaacttatttgatgctagactagacaacttattttttttttcttgcaaggaagactgaaggtaggagtaactaggaagcttaaataaacataaatataaaatgcttatagtgatagaattgacctcagccaattaaaattattaatagwaaaaacatgtcaatgtcaagcctactacctctgttctcacttgagtaatgaggattagtttatatttcccgacaagaatagatgggaattcaaatttcttcctgacctttgttccccctggaacattgggttaggatcatattagaacataaccaaaaagaaataaagattcagacgaattcacaattaatttttaagccccacaaaagtkaaataggtagcattattttttcaagctgtgaaactttccctcattttagtaatagagaaaatgttcagattataaacttggaaactttgctcctaacatatcaattatgccagaggccaatttttaagaagaagagaaatgcatgctctatattctcagcatcatccttgcccacaatagggaaataattttgtaaaatgtttgattttagacctccaaaattatctctatatgctacctgaattaagcaaataaaaaataatatttagaattccatgcaaggcactggtacaattttgtttatcttggcttcattgtttttgaatgtaagatgtacttttaaggcaaataagtacatgttttaagctggtcgcatacagtattggcaatgctataatcacaaatcagaaagtttggaaatgcttacaagtgttaagaggtgtgattcatcatggttatctgaattggcatctgatcttcttttctttctaaatatccctgacatttctgactcctctgtcttttcctcagtaaaactgcaccacacactggaaagcgaagatacacacatttatttatataatgtcaagggagagtaggaataagaagattggccatagacccacccaatcagagtctgggaaatgagaacactttttccttcagcagaaatgctgacgtgccaatgtgaatttagcagaaaaaagatttgccataacttctaagtgagcagccttcagaatgctagcttagattcctggcattaacttgccaggtattttttcaggaaggaaataaattacaattgagcttaaaaacctgagggtagaactcattttcaagcaaatgtgaagcatcagtttgaagttaacaaagttaaagtttggagtagggttcctccagtcctttataatgtagtacaagtattttttttaaatgtataacactagccttttaaattgtattgtgctactaaaagaaattgtgcctgcattcatcttacaacctgggaaccaacgcagagggtctstggggtagcggtatccagcttcatgccctctgtcctttattgctttctggttagcctgcgtatttcacatacattaaatattccacaataaactctgccatctgtgctgtagggtagtttgtattggtcatgtgctctgtcaagttgacagaggtgcaaagctaaatgtgtgacactcgaagaatatgcatatatttgaataatttgactatttagtccaacaatttgcaaaggcgctctgaatgatcacacattctgataacacttccaaggaacagatagcttcacttagggggtgggggagatggaagcagggttatttctagcaggaattcttgagttcactgaagtcttgtccctggtacttcactgtgtgaacgtgggtaaattatttcctggcagaggatcggattcttcttttataaaacgggtaaataatttctgtcactagtctttagaagttctaaaatagctaatgttagtgaattcattttgctaactgtaaacccttaggtaaattgaactgagtatgtaataatattatatattcagttcaacagcacattcttggtaaccacaagagggtccaggaaaggaaactgtttataaatctttccctttagcaaaattaatgttggagtctttagggaaattcttacagcaatagtcttcgcaattattaggtcaaacccctttgagattacagaaaaacgcacacacacagaaagctgcctgcagaatttgggtgtgggcttggtgggagattcctctgatacccagtgttgtacccccaagagagtgtttctcaaagtgtgacttcagattgtctgcattcgaattgcttgtggtatttattaaaattataactcctgggccctgccccacccctactaaatcacaatttcaggaggagggaccttcattttaacactcacccaggtgatttttatgctccgaggaggtccagggwctccaagttaagtacggtactgctgtcttattctttattctaaattttaaggtctgcacaaattggttgaactaatgagaagaaaattcagctttaaagcagaaacacaggtagacggttgacagagttcatcaaatggataattgaaaatgtcctctggaccctagccatataagttctcttcaagggtcttggctacaggcaaatgagaacccgaaaggctatttgctcttttgctgcgggcagtggtgggggtggagggcgggggaggattaactgagccagttctgcccccaccctcgaatcacctacccccactctggttaaagcagaagactttttatttatcttggctgccctggttcgttattaaaagggttagcttatacgtgtgtttgctggggctggaagtgaaaacatctgcaaaagcatgcaatgccctggaacggaactcttctaataaaagatgtatcattttaaatgcgctgaattttgattctggtaattcgtgcactagagtgtctatttcgaggcagcggaggtatcatatgacagcgcacgtcaaggcaccgtggagccctctcgtggactcccacccactttcccattcaccgcggagagggctgctctcgctgccgctccccccggcgaactagcatgaaatctccctgcctctgccgagatcaaatggagcttctcgctgatggggtgcgagtattacctccgccatgcaatttccactatcaataatttaacttctttgctgcagaacagaaggagtacataccgggcaccaaagactcgcgccccctcccccctttaattaagcgaagggaacgtgaaaaaataatagagtgtgggagttttggggccgaagtctttcccggagcagctgccttgatggttactttgacaagtagtgactgaaaaggtgggtttgttttctttctttctctttccgtttttctgtttggtcggctagaaagcgtgtggctttagcgaggtctgtcattgcctgggcttcctggctggaacaagtaacttggtgtaacgttatctgggggcgttcatcaataaaaaatgctgttattatcttgattgaattcctattaggcaaactctagagaggtcagtgcgcgaactctgtttaagccggcgtgtttaaggcagcagagtaaaccaatagcccccatgctctgtgcgatttcattgtgtgctcgcgttcgcaagctccgtagtgcaggaaggtgcgggaaggtgtgtctgtggcccgggaaacgcacgccctctcccagagaacttgggtgctgggatggggaggaaggggagagttgaaagctaggggagcgagacctcggggcgtgcgattctcactcgctccctcccgccccagcgcccacagccggggtttctgcagagggcgcgggacgcggggttccccggggctgaggctggggctggaacacccctcgaagccgcgggcgtcctgtccaaggcgccccaggagggcgcaggactcgcagggcgatgtcgcggggccctaggggaggaggtgaggacaggccccgggggagcggggagttccgggcgcccctcggttccccgcgcgaggaaaagacgcggcgttccctttaagcggccgcctcgaacgggtatcggtagcgcgggcgagcggggagcggggggcggggggcgggggggggggcggcgccgtttgaccaatcgaagctcaaccgaagagctaaataatgtctgacccgggcgcaaggcgcagcctggagctccgggtccccgccgctgccgccgccgcgcccgggcgcacccgcccgctcgctgtcccgcgcaccccgtagcgcctcgggctcccgggccggacagaggagccagcccggtgcgcccctccacctcctgctcggggggctttaatgagacacccaccgctgctgtggggccggcggggagcagcaccgcgacggggaccggggctgggcgctggagccagaatcggaaccacgatgtgactccgccgccggggacccgtgaggtttgtgtggaccccgaggtaggcaagcgctgggaatggggcttggtgcaggagctgcccgtccgcgggagagagttgactgggggatcccccaccccaaagttgtgggacgaggccagtctccttctttcctcccctccggtagaagggacgatttggagttactcttggggagttttctcccccatcccacaacccagaaggtcagccggcaccaccagggaaaaagggacccggggaagtcacgaagtagaggagggaaggcctggaggagacccagagctgcgtgatgggagcaaagacggcgacccggggatccctcgcagccctcccccagcccaggagtagtcgagagagacttagggggccagagctgtcgagggtcctgactgaggggagggtgctggggctaggctaggaatccttccagggggtgggtggtccccgcgccgacttgcggggggagtgggagggaagcttgcgccttcagcccgcatcccttccccggagctgcacacggctacctgctccccaggaattgagactgaagtggacttacaagtccgaagccaatgtagcttggaaaacttgggaggcggaattcctaccgctgggaactgaaagggtctgcgacactctcgggcaggccgaacccacatctctacccatcctgcgcccctcttctgaagcgccctccagggaagttaagagttttgactttcggggagtggttgggatgtacgtgggggattcttgactcgggttagtctctggggatgcagagccgggaagaggaatgggtgagtgagttactcctggaaagaaatagctgaggattgggggctctgtgcctgacgggcaagaagaaggggagattacagactaggggcatccctaaggaagaagcctcggggctgcgagggtgaactggaggatgcagtgtttgtgtgttgggggtagagcggggatgagggaccggggtggaggggaggcgaggaggaggaggggacccagagaacgaagctagggaaggtagagggtgccctctgccggccatgctgccaagagcagctactgggggcgggaggctgggggtggggaagtggtaaaggaaggttttgcgggatcccttagagagctggtaggagggacttgttgaatggtgctgctgactccagctcggtggggcgtgcgactcgtcgtcggtggattttgactcctcgttcttgtttggcttctatgcaagttttcctcgcgctgggggagctttgataagcctcgattggcggtgtgttagggcttcttggatcttattttagggtcctctagttatcctgcacttactccttaatgtcagtagcaaccaaagaacattttccgacaagcacgcaggaatgttcttggccagaagcaaagaaaggcatatttctgagtgtttattaatcctcctagtaatcttttaaagcaaagtaatatgtaattgggaacgttgattttctaactgcatataaaaggcgacatgatattaaatgagacccctccctactgrctcaatatcctgcaaaatctctctctcccctttattattatcgaaaaatctatttttatatgagtttgttgtaaggtcaaaagccattttggtcttacaatttgatatgtctttacattttaacttattgaggcataattacagatttaatttgtatgaacgtgtgtgccttcaatgcttatctcatgcaacataatttttaggttggagatttctgatgttatggcatgtagcgtttcaaggcattacacataataggtaacatagcatgttgaaattacaccacaaagttttgaccctgggaacagcaccttttaaaaacaatcactaaactcctgttcctgttttctgattttgcaaatgccttgcttaagacttttttttttttttttttttttttttttttttggtaaatttacctctgggttagcaggagaggtaagagaaaggaaagagacacttgttgaaatgtaaccataacctttactggaatttaaaacatgttggtcaccattactggaattccagggccataaagtcgttgtcttttttttcttctacttcattttgtaaaatgtgataaatgttggtaaatatagaccagtagtaagtattatgacackaaaagcattatgtatgtggaactattttaagttattacagaacattttctatttataaatgatataagcagaaagaaatgatttccagataaacaaggcttacgtacatgttttgaagcattagaacattgcagacactcttagacatcacattttttaaagcaaaataacagtaatttttcacatacctttggagcctttcatagcccattcagagctgagttagtagctggaagtttcctttattttaaggtgatattttaaaaccatttaacatgtatagtaggtcaacattggtgcatccagaaaatgaagcatttaggaaatctgtttcagtgtcttttcaatgtgtgtaacttttacttgcaaaccaatggaaccaagaaagtcatcatttgcctaaaatgcagtcatcacctcaaatgattcatttatactatgtgagttaattgccttcatctcattaatggccaaggagggaagggaggtcctggggtatttcttgttcattttgactcaccaggagggaaaatcctgtaaaaaaagaaatgcaaatttctaaaatcctggctcaaagtccgtgggtttcctgtttaaaaggggcgccatgaaaatgtaagctattccctttttcctggaatctttaagagtcccagcttttcaatagtcaaaatgtagatgattgatatcatttcttatatgaatagcactggtttgtagttcagcacgcacagtgagctgggcacgcccacctgatagtatagcagagaacttgtttacattctttttacattcatcttctaaaacctggggtgctctctctctctctctctctctctctctctctctctctststgtgtgtgtgtgtgtgcgtgcacgtgcgcgtgtgtgtagagggggagagagagagagagagaactgtgaactgtgaaatataacacagccagcagctttgggtctcaatcgtagacttactcttaaggaaatttacagaatggaaaggtcatgttcaagtagtttattaacattttgagatgtaggaaattaatcccggagtacagaagaacaatttcagacttcctgaataaaaacagacagcatagagagtggatgatagctaaactctgaatatcttttgagaagaaaggcactcccatttcaggtgcccataatatggatttgattttagtgattaaaacattaattttcaacttgcatctccctgtgtggaagagttcaatttgtgtgaggggtctcgcctatccaacaaaagtgaatatgtcccttttatagggtaattgctaacttgtctcaacttgttttcaaacaattgttatagagcactcagtttccactaattgcaaaattgttgcttaattgaaggactctcagccatctagtgcagccattcagccactggcaggctctgtgatctcaaactgtgaattgcattttaaagaggaatcgaggagagaattctgtggaattctaggttttaagtgctggctgttgttcaatggaagaggaaatcatttgaacaagaatcgcatcaagttgtgttgtgataaattttctttattaggatgaataacatgcacagatgagcttcaaaagtgaatgagcaaacttactggttacactctgcatccatttactctgtttagtatggagtaatgttaggcaataaatgatgctggcaaatgaaatccgtatgttatttgcatgtggtatttaaacctaggaaacatagagtggctttggtatttgtaggcttagtcatgtgtgtcctaaacgtcctcttaaacttctacttaaggcatagaattayttaatcctaaataattttatacttaagtgcctcactggatttccagaatatttacactgtaaagatttagaaaggtcatgaacccaattattgactatatggaatcattattgatggcagatgcaaaatggagctcactaatgtactgacattgaaaaccttttgcaggggagaggagggggagtggtaaatgtgtgtgttctttaagtggaacaggaaggtattctcttttctgtagaaaaatttgagtatctggtcagataagtgtggaagctttcatttaaattaagtatttaagttcaagtagaagctctagggcacttatcctcttgatgagacaaatcttatcaaatatactagatgctaagaagtggctcattgccctgatgtctcatttatagattgatgtttgaggatgggttgcattaagtgagttagggggctgagtgtgggacaggagaacgattggaaggaagcaaagtaaatttacaagctttagtgacagccataataaagtaaaagtttatttccagagagcctagagagtaaggaacgttatatagttttccccaaaggttcacttgaaagaacttttcattggttgtcatggtagtaatgtcctgattttgaaatctcccagaacctagtagctcttaaacatgctttcatcttggttcctttggtctgacggaaactttatgacgaccctctgtgtttttgacatgcctctgcatttttggagagaggaggtcaggcaagggaggatttcttaaaactaagacagtatagtaaggaaacataaaattatatgataaaaaatcactgaacttcaaattgacttactgaaataaaacctagaaggcaacctgtcgtttaattacaactagcttgtataaaattaaaatttataaaatgggaattcaaagaaaataaacgggcagttccaagtaatttaagcaactcaccaaaaattgaagtaatagtgccacctagagaacaaaatcaccagctttactagccaaatggcttatttccatatgaaccatttttccaacgctacagttactaggatttccttgttaccatattcagatcttgtgagtgtgtatgggggtgggggttgcatgtggaattacagatgaaattttaaaacaagcagatccacaatttgatatatgcactaaatccttttaacgttgtaatgtagccaaatgtagaatagcatgccaggaatcaacggctagcatcctttttaacatttattattttcatggatatgtaccaaaccgaaccattgagtataaaggttctgattttatttatttgctacaggcaattcattatactttctgagatacaataacaccaaataatttgagtagagagacctttaagaatgttttcgatttatgatctacctttaactttaatgtactcagaagatgtgagaataaaataaagtcaaatataagcaagattttaaacacacacacaaaaaacaaacaaacaagaaaaaggaagaaaattataaggattgccttaaccttagaatagatgaaggtatacatctgagccagcaccaaaaaaaaaaaaaaaaaagttatggaaccaggaaccaataattacaaattgacttaaaattcttggatgacaaaaatctatatttagttcatttttgcatgcgcccacaacagcatccaaaacagttctggggaggcactttgataaatgttgctgaatgcactaatagattgattaatggctgcttcagattatcactagtgatgtagacagaaacttcatgaaaatggtttgtcttgctggaagaaaggcagaaattggaggaaaaggtttaataatatttttccccagtacctattataaaagtcatttagttggcttagttctataatttcttatgtgtaatttgattcacttatgaaattgtgaatatatgaaatgttaaagttgatttagacagcaactataagcttgtggattttcttttaaatgtcttcaaatttttaaatgccagtggagatgccagcgactgtgcttcagggagtagaatatagtatatcttaaatttgtgccaatttctggtaagcagagaaaaaattgcatgataaccaaagaaagtcatattgtttgtgctttgtgttattcatggaagcaatcaggtgcagaaaactttctttttcagaaaaaaaaaattactaaaataaaggtgcgtgtgtgtgtatgcacatatatctaaagggagagagggagaaggaaacttactaaataaaatttttgccacatgggatttagtctaatcagtcttggttttggagttgctatcatcagtagttccattttgtgattctttctttctgccttcatgtgcctttgaaaactgaaactatgcccaaattaaaacaagtttttctgtcttttcacatgttcacttatttcttgaatgtgtttttaaacacagacaaacttcttttacatcatgtagaatctgaaggtcgagaaatttgcagtcattttgctggagagagatgcttggcggagtcccaggccacattcctaggccaaactctcgaaggtattcctcttatgcaacattgggaaaatacatccagcaccgacatgttggctgataatgtgtctgaaggcacagacgatatgcttatcatatgaaacataaagccagcagatattgcagacattctgttgaatgatagaatctggatcatttacatttacttaaatgtaaaatactatgattaagtacaaaaaaatcaatttaggagagaatagagagttgcgggcacggttttaggggatgacttatcagcagattgtagaaaggaagcttgaatgttttaaattaactgcaagttcagtataagccagtggtgtgacaagaggctgttatcatagctactgaaattttgggctgcactgctagaaatataatactgaaatggagaagctaataattcttcactttttaaatagactgtatctagaatattatcatcagttcaaggaaatgaaataagttgttttaggtacatcatcgataaattagtgtacattcaaatcactgtgaccaggatgcatagggaatttgaaagcattgcatgtgagcaatggttgaggggacttggaatgcatgacttagggacaagaaaacttaggctggaatggcaagtggtttttgaatgttgggttgagaagaattctaaaactgtgaaggattagtaaaaataacattcagattgctaatgcctactgtggctgggagattagagtgtcaacatgtgtgatgtatttttgacatccttattttgaggatgggcttcaaagatttgacgaactgtcataagtgtaatttgtgttgcttcagacagcagttctagaaccaatgatgtaaatttagatactctacatggtagttagaaaactttccattaatttaatttagcaaatattgaatgctcactgcatacagagcactttattagaggaatatataataaagaaaaaagaggtctggtgtggtggctcatgcctgtaatcccagcactctgggaggctgaggtgggaggatcacttgagcccaggagatcattacgagtctggacaacatagcaagaccccatctttacaaaagacaaaaaaaattatccaagcctggtgacaggcacttgtagtcccagctacttgggaggctgaggcagtaggatcgtttgagcccaggaggttggggctgcagtgagccgtgattgtcccactgctcttcagcctgggtgacagagtgagaccccgttggagggaaggaagggaaggaaggaagaaaggtaggaaggctgaaatgaaacccttttagaaatgacactaaaatgggaggttggagtaaggtattttctgaagtgcctttgtacttgtttttttctaatgcattggccataagtctgctccttatttatagtccataaacaatcctaatgagaacagttatatatttctgcctttgaatcatctacttgaagtgtttagcatcatgaattgagtatcagaaatccctcccatttctttgcaaagcgctgtattttacttttccttatttgtatacagattctcaaaattggctatttttcctttgggttagacagaacagaatgtctggaaaaaaaagttcttatcaaattcaggtgcccaaattgcttaagaaattaacttttgaggttatatttttttagggttcagtagctaaactaagaaaacttctcaccgttcaccttcacttttggaaaccacaaaatcttcagatattacagttttccaaagagtttctctttttaaatataaactaaaaggaattgactcctcccccaactccctcaggcctcagcatggatagagttactttttttctttaataatttatttataacttattttgctcttctgtagaacagctggagattaagcaacatggccatgacataaaatgcaagttagaccataagatgagcagcccactccaagtatgaatgagtacttattctttgtgatctctcatactgcttttaggtattaatagtgtcagtcagcaaagcaaacagtttaatatttacatctcctttaggatatcatatagtttatagtttgtatgtgttcttgcgtgtatgttttcttctgtttcaaattcttttttcttaaagtaagaatgttatatgtagcaaatggttctttcattaattcatttgttaattcaccgtgcattaattgagtgcccagtgagtgtcaggcactgggctacttggatttcttttccctgtattgatccatatatcttcaggtgctccttgatatggctctccattgactctctcatataaggctttcattacctattcacatactccctcccaaagaggactggtccaaaagtaaaatcttgagcaagttctctgagttatttcagaacttcttgcccccaaactgtatttttaattattgactggtagcattttggaataacttacctctcttttttaaagattgaagttctttatcctctctgattttcaggtgtcagtttgtgtacaaattgagacaataaaaatgtttgttagacattttcttaaagcattttgctatgtgagaatctttcatgaagaactctttttaacaatgactctatagcagaagccacagtagagggagaactactgaatcaaagatggtgtttgagtctatgattttatgatggattttttttttttttacatacaaggatatgcatgggtcttttagtattcaggaatctgttcttcacttgacagtatttayaaattgtgtgtttccccctaaaaaaacttaaattgtgagaatgcttccatttactagaagttggttaatgattatgccaaataaggaaaataagacagaaaaatcagtttagtgaatactattttgcctttaaatttagtaatttagtaacagtatctctttggggtttactagaaaccactttttaatccaataggtctctttcattgtgaagtcaggaggtgattttgcttaaatgtgtagtataggaatctatatgtggtgttcaaggatcatgtaaatatgctgatataatcggagcacagtttggcatcattaactcagaaatatttaaactcttgctatacaacatggaagcaaacttgtgcatagtttgtgtgtgtgtgtgtgtgtgaatctcaaaaaaagaaaaaaatcacaggatcaggaagtcggaataggtcccacttttcttctagtaccaaacctacagccatgttcctagccttctcttttactcccaagcaagacagacaggcaaatgaccatcctgctgcccatttctgtgtatattcacttgcattgagagttgtattcacctgcttgttgagagtattcacaaatggtacctgataaagtagatacttctttaaacatgtgaatttttttgcattgtataatgtttagaaataatcatgtataaatggttgaatattaatacaggattgccttatcaagtattttattaatcattaaaatgtggtgtcattaatacaatttattttaagtgcttttcctaaaataccagattatttttctgattttcacatccctgacaatgactttcttaaacttggtagccaggaacagaaaacctaacactgcatgttctcactcataagtgggagctgaacagagagaacacatggactcagggaggggaaccacacacactggggcctggagcagggggcaggggaagggagagagtgcgtcaggacaaacagacaaatagctaatgcatgcgagccttaatacctaggtgatgggttgataggtgcagcaaaccaccatgacacatatttacctatgtaacaaacctgcacattctgcacatgtatcccggaacttaaagtaaaataaaaaataataataaaataaaataaacttagtagcatctattgttccagagcctgtaattgctcttcaggcagtctcacataaaaacctaggagaaccttcactgtcactgttccatgaggtgttaggaaaacttgctctactgcagtgccccagtaggcattggtactgagaccaaaattcagctggtttgttgttactacgattcctacgtgatttcacttgtcatgtagacaagattgcacacttcaataataatcttgtccaaatgtgtggtattccatacatttttaaaatgcattcacatatctcattccatttgatcctacaaataactctataaaaaagattggcagacattatttctatataacagaggaggaaactggagcttagagaagctaaatagcaatccaaaatgcacagctgtagaaccagagcaaggatgatagcccagtgacttcacctaacctagtccccttaccaccactccagctgtctataaccaaaacctgcagtattcaagtaagaaaccatatcttgcccttgatgcattaatgtgagacctggagcaggaacaggctgatattgtcaccctggcctactgtccacctttgtctccagcagagactggtacccttctgtgtgccaaggaataaagtggtaatgggaagattaaaaatgttttttccaaggagttttttaatttaatttttttaaaaaagaaaaaactcttagagggaaaaatgaatatatgacttttgatgtattgttccttagtaacttagttataattttacttaaacctgagactcttgctaagtgaatgattagaaatattaggtggctggccagatggcaaataggaacagctgcagtctgcagctcccagagagatcaatgcagaaggtgggtgatttctgcatttccaactgaggtaccgggctcatctcattgggactggttagacagtgggtgcagcccatggagggtgagccaaagcagggtggggcattgcctcactcaggaagcgcaaggggtcaggggaactccctcccctagccaagggaagccctgagggactgtgccatgagggacagtgctatctggcccagatactacacatttcctacagtctttgcagccggcagaccaggagattcccttgggtgcctacaccaccagggccctgggtttcaagtacaaaactgggtggccatttgggcagacacccagttagctgcaggagttttttctcataccccagtggcacctgaaattccagtgagacagaaccattcactcccccggaaaggggctgaaggccaggcagccaagtgatctagctcagcagatcccacccccatggagcacggcaaggtaagatctgctggtttgaaattctcactgccagcacagctgcctgaagtcaacctgggatgctccagcttggtcgggggaggggcatccgccattactgaggcttgagtaggctgttttcctctcacaatgtaaacaaagccactgggaagtttgaactgggtggagcctaccacagctcagcaaagcccctgtagccagattgcctctctagattctccctctctgggcagggcatctgggaaagaaaggcagcagccccagtcaggggcttatagataaaactcccatctcatgggacagagcacctgggagagggggtggctgtgggcccagcttcagcagacttaaatgttctttgcctgttggctgtgaagagagcagtggatctcccagcacagcacttgagctctgctaagggacagactgccttcttaagcaggtccctgaccctcgtgattcctgagtgggagacacctcccagcaggggtcgacagacacttcatacaggagagctctggctggcatctggtgggtgcccctctgggacaaaccttccagaggaaggaacaggcagcagtctttgctgttctgcagcttctgctggtgayacccaggcaaacagggtctggagtggacctccaccaaattccagcagacctgcagcagaggggcctgactgttagaaggaaaactaacaaacaggaatagcatcaacatcaacaaaaaggatgtccacacgaaaaccccgtacaaaggtcgccaacatcaaagatcaaacatagataaatccacaaggatgaggaaaatccagcacaaaaaggctgaaaattccaaaaaccagaatgcctcttctcctccaagggagcacaactctttgccagcaagggaacaaaactggatggagaatgagtttgatgaattgacagaagtatgcttcagaaagtgggtaaaaacagactcctccaagctaaaggagcatgctctaacccaatgcaaagaagctaagaaccttgaaaaaaggttggaggaattgcyaactagaataactagtttagagaagaacataaatgacctaatggagctgaaaaacacagcacgagaactctgtgaagcatacacaagcttcaataactgaatcgataaagcagaggaaaggatatcagagattgaagatcaatttaatgaaataaagcatgaagacaagattagagaaaaaaagaatgaaaaggaaggaacaaagcctccaagaaatgtgggactatgtgaaaagaccaaacctacatttcattggtgtacctgaaagtggcggggacaatggaaccaagttggaaaacactccttaggatattatccaggagaacttccccaaactagcaagacaagccaacattcaaattcaggaaatacagagaacaccacaaagatacccctcaagaagagcaaacccaagacatgtaattgtcagattcaccaaggttgaaatgcaggaaaaaaagttaagggcagcgagagagaaaggtcgggttacccaaaaagggaagcccatcagactaacagtggatctctcagcagaaaccctacaagcctacaagccagaagagagtgggggccaatattcaacattcttaaagaaaagwattttcaacccagaatttcatatccagccaactaagcttcagaagtgaagtagaaataaaatcctttacagacgagcaaatgctgagagattttgtcaccaccaggcatgccttacaagagctcctgaaggaagtactaaataaggaaaggaaaaaccggtaccagccactgcagaaacataccaaattgtaaagaccattgaaactatgaagaaactgcatcaactaatgggcaaaataaccagctaacatcataatgacaggatcaaattcacacataacaatattaaccttaaatataaatgggctaaatgccccaattaaaagaccacagactggcaaattggataaagagtcaagacccatcagtgtgctgtgttctggagacccatctcacatgcaaagacacayataggctgaaaataaagggatggaggaagatctaccaagcaaatggaaagcaaaaaaaaagcaggggttgcaatcctagtctctgataaaacagactttaarccaacaaagatcaaaagagacaaagaaggccattacataatgataaagggatcaattcaacaagaagagctaactatcctaaacatatatgcacccaatacaggagcacccagattcataaagcaagttcttagagacccacaaagagaccaagactcccacacaataatagtgtgagactttaacaccccaatgtcaatattaggtcaacgagacagaaaattaacaagcatattcaggatttgaactcagctctggacccagtggaactaatagacatctacagaactctccaccccatatcaacagaatatacattcttctcagcaccacatcacacttattctaaaattgaccacataattggaagtaaaacactcctcagcaaatgcaaaagaatggaaatcataacaaacagtctctcagaccaaagtgcaattaaattagaactcaggattaagaaactaactcaaaaccatacaactacagtggaaactgaacaacctgctcctgaatgactactgagtaaataacaaaaagaaggcagaaataaatacattctttgagaccaatgagaataaagatacaacataccagaatctctgggacacagctaaaacagtgtttaggggaaattcatagcaataaatgcccacaggagaaagcaggaaagagctaaaatcaacactctaacatyacaattaaaggaactagagaagcaagagcaaacacattcaaaagctagcagaagacaagaaataactaagatcagagcagaactgaaggagattagagacacaaaaaacccttcaaaaaaatcagtgaatccagaagctggttttttgaaaagattaacaaaatagatagaatgctagccagattgataaagaagaaaagagagaagaatcaaatagacgcaataaaagatgataaagaggatatcaccactgatcccacaaaaatacaatctaccatcagagaacactataaacacctctatgcaaataaactagaaaatctagaagaaatgaataaattcctggacacatacaccctcctaagactaaaggaagaagtcaaattcctgaatagaccaataataagttctgaaatcgaggcagtaattaacagcctaccaaccaaaaaaagcccaggaccagacgtattcacagctgaattctaccagaagtacaaagaagagctggtaccattccttctgaaactattccaatcaatagaaaaggagggaatcctccctaactcattttatgagtccggcatcatcctgatacaaaaacctggcagagacacagcaaaaaaagaaaattgtaggccaatatccctgatgaacattgatgcaaaaatcttcaataaaaaactggtaaactgaatccagcagcacatcaaaaagcttatctaccatgataatttggcttcatccctgggatgcaaggctggttcaacatatgcaaatcaataaagataatccatcacataaagagaaccaatgacaaaaaccacatgattatttcaatagatgcagaaaaggcctttcataaaattcaacagcccttcatgctaaaaactctcaataaactaggtattgatggaacatatctcaaaataataagagctatttatgagaaacccacagccaatatcatactgaatgggcaaaagctggaagcattcatttgaaaaccggcacaaaacaaggatgccctctgtcaccactcctattcaacatagtattggacgttctagccagggcaatcaggcaatagaaagaaataaagcatattcaaataggaagagaggaagtcmaattgtctctgtttgcagatgacatgattgtatatttagaaaaccccatcatctcagcccaaaatctccttaagctgataagcaacttcagcaaagtctcaggatacaaaatcaatgtgcaaaaatcacgagcattcctatacaccaataatgacaaacagccaagtcatgagtgaactcccattcacaattgctacaaagagaataaaatgcctaggaatacaacttacaagggatgtgaaggacctctttaaagagaactacaaaccactgctcaatgaaataagagrggacacaaacaaatggaagaacattccattctcatggataggaagaatcaatatcrtgaaaatggccatactgcccaaagtaatttatagatccaatgctatccccatcaagctaccattgactttcttcatagaattagaaaaaactactttaaatttcatatggaaccaaaaaacagcccgtatagccaagacaatcctaagcaaaatgaacaagctggaggcatcatgctacctgacttcaaactatactacaaggctacagtaaccaaaacatcatggtactggtacataaacagatagatagaccaatggaacagaacagaggcctcagaaataacgccacacatctacaaccatctgatctttgacaaacatgacaaaaacaagcaatgcagaaaggattccctatttaataaatggtgtcgggaaaactggctagccatttgcagaaaactgaaactggaccccttccttacacgttatacaaaaattaactcaagatggattaaagacttaaacataaaacataaaaccataaaaaccctagaagaaaacctaggcaataccattcaggacataggcatggcaaagacttcatgactaaaataccaaaagcaatggcaacaaaagccaaaattgacaaatgggatctaattaaactaaagagcttctgcacagcaaaagaaactaacatcagagtgaacaggcaaccgacagaatgggtgaaattttttgcaacgtatccatctgacaaaaggctaatatccagaatctacaaggaacctaaacaagtttacaagaaaaaaaacaaccccatcaaaaagtgggcgaagggtatgaacagatgcttctcaaaagaagaaatttatgctgccaacaaacatacgaagaaaagctcatcatcactggtcattagagaaatgcaaatcaaaaccacagtgagataccatcttatgccagttagaatggcgatcattaaaaagtcaggaaacaacagatgcaggagaggatgtagagaaataggaacacttttacactgttggtgggagtgtaaattagttcaaccattgtggaagacagtgtggtgattcctcaaggatctagaaccagaaatatcttttgacccagccatcccattactgggtatatactcaaaggattataaatcatgctactataaagacacatgcacatgtatgtttattgtggcactattcacaatagcaaagacttggaaccaatccgaatgcccatcaatgatagactggataaagaaaatgtgacacacatacaccatggaatactatgcagccataaaaaaggatgagttcatgtcctttgcagggacatggatgaagctggaaaccatcattcttggcaaggtaacacaggaacagaaaaccaaacaccacatgttctcactcataagtgggagttgaacagtgagaacacatggacactgggaggagaacatcacacactggggcctgtcagggtgtaggaggctaggggagggatagcattaggagaaatacctaatgtagatgacaagttgatgagtgcagcaaaccaccatggcatctgtatacctaggtaacaaacctgcacgttctgcacatgtaccccagaacttaaaagtattattattattwtaataataataataataaaagaaatacaataaaatagaatgcagcatacagcagtgattctcaaacacattcagcatcagaattacccttgaatctttaaaatatatatacatatgagatcttagtctccaagatttgtaagtttggtattgggtccctgggcctatgttgggtttagaaacttctacagatggtttggatgtatgggacagtttaagaatcgctgaactaaaatcaaataaactgaatatcctgtgatttagagagacttatcgtttatttcactatccaagtacttgcattagagcgtggctagaagggatttgcagccttgtaaataatcagaaattcagacattttgagatgagagaactgctgaagattttattctgacttgaaataaattttctaattagaaacttccaggtgagagcaaaggcctggaacaatattcctgagccagaggaggatcgagtttgwctccaggcctaacacttactaggtctatgaccttgggtcagtaatttaaattctctgtatctcaacctctcaacagggtattggtagggattaaatgtgttagtgtctgtgaagtgcttagagcagtgcttggcatagtaaatgcttaatgaatttcagccactgtttttatttttagtactttccagctcccccaaaaagatactttttttagacttgtattaagacaataaaaagtttaatcagcatgcttcatacctaaatatgcttcactttatagcaaagtttacawgactaaaactgttttgttgtaattctctgagtctcatgtgtttattaatgattttttctgctgtttattcatctgaattctactcattcttcaagacctagctggaatcctgtttctagaaagactcttgcccataataataaacctgccctatctgagttcctaggtggtctgtacctcataatttggtaattaattgtatatgcacttatataacaaaacattattgtgtgtctttgctgtatcagattctaggctggaagttgtagataygatgtttttgtctagaaaaatgttctagaatgtcctactcaggacagtctgttgactttaaagacacatttcctaaacagacacttcatgaggcagccccagcctgtacctgtgttcctggacctgatgatcaagtttgatttaagcctcaccacttactagctctgtgattttgggcaagttacttgaattctctgtgtgtagatagaacaatgttgagggaaatccctttcccccatccttgtgtttccacaagggaacttgcttcctaataagtaacactttcaggggaatattctaggcccttctcttatccccattacttgttctttctgtgaaaagaggagaggttaatctgatggatgaaatccttaatctttcatcttctggactgtagagcctgtgaaccaaagcaatggaccacttgcactgaaattgaggctgaccctgtattttgattcttatttggcaacttatttctattctgttcccaattcaaaatcccaaggggagaaggaagataattgattaccagaagtatgtaatggtggtaggaagttgaataaatggtaactttttaaaagttgcatgagatatagtccttatcccagagaagctaagtttgcttttctttcctctcatgtattttagtattatttctacaattagattgtaaaccctttaaaagcaagaatatttctacattttcttactcctgatagcacacagtagactgctgggcacatacatagtaggtggctctgtaggtacttgctaaatgattcaacatgtttttccctcatggaaaagaaagatttcagtattgttcttatcagctaggaaggcactctgaataggaaatcagttctaggcaggtatccataaatgggttatgatttccaacttacttgccccagaggctcgctaatgttgaactcttcatgggtactttgtcttgcttcatgagctatacatgctaaggggttagcagatcatataatcttttgatctacaaaatatgatctttattgaacaaaaacttgggccaaaggcctttctcctttgccaccttcctccctcttttcattctcttttttgggaatgccctttgtgcatgttagttacagcatgtaccacattgcactgtattgttggtttttgggtctaacccacccttaacactgcagtccccaagggcagaaattcagtctcattcattttgatgtcctcagtgcctgtgctcagagaatatctattatttgaaaaaatagtgcaaaagtaaattttaggagactacatcacactcatctaaactgcaagtttgacaagttgacatccaaaagaaaggctctcctaaataacctcgccacagaaatttgggtgacctttgtagytctggagaaagcagaggcaaaaatgaaacctaaaaattatttgtgggtttttaaaaaatgttttctcatggagtaaaggtctacagctgagttcttttcatatgagggaatgacagaaacacagctggttctgactttcagcttcaactgagcgaccagagctctgctggtgaaacaggaacttgtattgtgcccctgacgtgcaccttgaaggtgtcagctcattgtccctttgttcacataaatagttttttaagaattgtttttgatcttgtgagcctctaactaaatgattaaccatgcaaagttggccatttggggtaatactgaagcacttctcttgagggctattgacaggtgggaatgtgcccacctccttgggtctctggttttcatgtcatacttgcaaatcagtgacagtttaaacttggggcaatcacttagcaagtctattgagttaccaagttaattattcccactttgcatgaagcaaccttgaaaatgattttcctaaagcaaagtacatccaaactcagtaccttcttaataacctttgctgaatgaataaatgactaattcataaaaaatgtaacatatctttaattcttacttacgggcagtttaagcctcttgtgtaagaggaggcctcggcttgagataacataggatagtaagcctcctagagaaatttctatatggaaacatggtctgctatgaagctagaartgagaggacattatatttgaccattatatttggcttcagagcttctcaacatggggcccaaagtcaaggtcccttgtttcattaagaggaggtccaggagtgcatgacacccatcagactactgagacccagctggaactaggcaccttgcacaggggccttgcctaatcaaaatagttcttattttttctgagttccaagtaactagtttcctaacccagtgtctggatagtagtgccaagtgggagtaccttcaatgaacttcctcatgaggttatttctagcctattggaatgtttcgttttaggagggtgaggaagggaagtcttgaatttttgtgcttagtttaatgttgtgatacagctttgaccatccgtttaatgggagatctgttttccagatgactatacatgtggaaaggagaagttttttgagtgttttttttaaccccttttaaagaatggtttttcatttagtstctacatttgggggtaaaaggtcctctagggagacttttcaaaagtatttgaagtttgcatctgatttcagaggtgagttggaggcctatctgtgtatgacagacacatgtctccaacaactatatgttcacaaggactaagagccatccttttgggtccatcattcaacattgatctcacattcgtgttcrtatcagtatctttacagtgcgctcccagttacatctccctaatttcccttagtaggcttcacagaatttgcagtgtatgcaatggcagatgaccacatgtggagtcatttaaccacatcttccactgcaagtcagcccgctcttgatgtctgtttatgtttagattccatcttttggaagatttcattcctctgcactatctcagtatctcagatgcttttgagamtgggtccttttcccctcctatgtttggccatggccaccccctcagggttgtgttgtgtttcacagctgctgtttgtagggttgacctttacaatgtacaaagctctttcccatatgttgacaatccctggtgtgatgctgtgagttaggcagggtgtgtatacgtgtcctcatcatattacagtggtaaggcaacagggtttttgaatttgatcacccatgaatttgtctaatttgttggtaaaaaatggtcatgtatcagccgtttcacagggtcagcttaatagaaagtgggagttaggcaggaccagaattcaggacttcagcccccggtcccagggactattctctatacccaattgtcccaccttgaatcagtttcttctagggaaatatctccaaaactgagatggcacccacaggacttcttaattgtagtcattaccaggaaaaacaagcaaaggaactggtgtaaatctctgtttttggtgattggtggagatttggagattgtcttgtgtcaaaagtaaagccactagattaaatgttttgttaataaattggttatttttaatttaattatttgacagttaatttacattattcaaaaatcaaaataaaatttaaaagaagtttacactgaaaagtcttgccccacttataccctgctcacctcagtatcccccaatacataccatctataaggtgatcatttgtattagtttcttgtgaatccttgatagtgtgttttatatagatacaggtaaatatgagtatgtactattatttcccccccaccccaccctgttttttttttgagacggagtctcgctctgtcgcccaggctggagtgcagtggcacgatctcggctcaccgcaagctccaccattttcccccatttttaaaacaaaaggtagtagccatatatacactattttacaccttgttttatcacttactaatatataccagagagctttccatcattttgtacatatgcacctatatctgtcaattattcccagaagtggaattgctgggtcagcaggaaaaatcatgtataattttgataggtattgcctaattgtcctgcacagggcttgaattgtttgtactcccacctttagtgtatgagaagacctgtttctccatagcctcatcaaacagagtgtgtgagattagatgagaaataggaggtgagcagtcttttaccccatccgtagtttgcagtgggaacactgcacagttgcaagagctggtgcaggtatcagattagttccagtggaaacgctgcctcaccatggccatgggcttgcgccagctctagtgacacacacggaatggacccacgttgccacttgcagaatttcctgtagcagaaagttgaacatgcattcattattcatctaactagccatgctggatctaaagagcacaacagtgttttttagaaccaaaaagaaaattgtttcactacaacacactgtgtataaggctttcaatgctcttttctcagctattaacattattttcaggactgagttcaagagatgtatcccaaatcacagggatgtcttgctaagcttggaactttcatactcaagggatgcttttttgaggaatgattttacacttactcaacatttgtaattaaataattagtactttataagataaatttaaactgtccaagtacaatataaacattgaactatgatgcattattgctagactttttccttaaagttgccaagtggtttcctgcattaggcaaataggggatcatataaaaatgccatgatttacggcctagataacatctccaccatttgagcagcatatattccaggtcatccccacataactccttaccattctcattagaaaggttgattcttagtcttatttttctctgaggacagcaaaaaaaaaaatccccttcagttccactgcatagaaaagtgtggtaaatggagccgggcacagtggttatttaatttaaatggacaatattttttatagaattttgacagggccactgtataggggaaagtcactcctcttcccctttatagaagagttgcacctggacagttgcattgatgactgtatccagtctacacaagaggtcattcctgggcataagaatggactgccaaaatctagctgaaacaccattgacaaatagacattttcttttgttaataatacctgtgaaggctttcataacagacatttccagttttgttctcaggctccttgcagctgctcctctaaaagtgtgctctcttccaagagctgacaatggccagaagcaaggtgttctgtcttttgtgccatcatcatctaacttgccacacacatttgggatgtcagcctaggtataggttttgtatccactcagtatggcttgtgggtctggttgcctttgttattcatgctgagggcctctgggcatcagtttggtgtgagagaacccattccatgaccctccttcctttggctgttttgactcgatggctcttgttggcacagtctgtgagtgtctgatgctctatccatgccggaccatctgttctgctgtctctgtggtctgaagtcgttttctgaactattccttgataataaatttgagatgatcttgttctacctttcttttcaagtcacatcttagccccttagccacattcccgaagaacatgacaaatggatgggtcacaagtcacgtagcatagggtgtcagaccacgaggctttgaagggattctgttgggtgctaaaaagaaagattttgtgtcaccacgattttttttaaaggcatgttgacacttaggccttaattgaaagcgttcttactcaagtagagttgacagaggagtatttggtagtcgcggttgctggtctgaagagcatgtggttctgtttcaatgcccaatgagatcttctcacgggaaaatgttctgacatctcaaacaaatgaccttcatgcatagttttgacaaaataccctattaagtatgcatatatggttggtaccttgtggtaataattcaatactggaaacagagtagcaacaaagaaacattagggttatatttaacctctgtggaattagtgtgtaaacaaactgcttatcagaaatgctcatatggggctttgtttaaataaataagaaactggcatatagggtctgcaggatatttctgccaagtagacctccctcacattataagacaccacatctatgtctgaccccatatggaaagaggcatagcaagccagcactggttcatattccctctccaccacataatgggtatgtgatcttagggaatccaccgaaactctctgggcctcagtttcctcagctataaatggtggataatcaaattatttacctcaccattaataaatgttagctattattttttatcaagtttaatacaaagagaaacattttacttatttttccagctatccagagcatcttccaaaatcctatcaccaacaaatactgtattgtatttattatagcaactatgtaaaaatggagtccctgtcctatgcttagatgaaatatgttggtatttgagtttgcatgtcttctataggaatcagtgtttagtgaaaacgggtggagataaacagatgttttcacagtcctgttgttcacagtaccgccaaattgaatgtttccatataggtgcattctaatggcttaaatgatgcagatattttctggccagccatatggatcttttgtcatctaagatgttaatattttccttatattttatagtagttctggagtacagccagtttcttgaatagggtccacatggctcattatgcacagggcctggaaactgccttactcgtgctgttgaaatgaaccgtgacacttcagaagagctgggagctggggtagagcagtggctaggagaacatattcaattatatttcctcctgcattaagctacaagtaatgakcactttcctgtgctttacagttaagtaattaaaagaaattatagagtgggatgcaaaaataacccgaaggacaactggatgtgtggagccaccagttttctccatgagtgcacaaggttaatccttgttactactcagaatgctgagtttctacagaaagggttgcaggtccacacatgttttggcgtctacccacacgcttctgtatggcatgactgtgcatcccagaagaagggctgtgctgtgtacctccacgtttcagtggaatttaacaaactgatccctgaaaatggtttcataaaggtgagtaacagagagctaatagccttctcttgctaattttatctttcccccaagatttcttgataatagtttgaaaaggagtgttattctttggtctctagaggcaacttacctttccagtttcttccatcacctgttttcacctctcttgtttttttaaatttaatgctctatgtatttcagaggataggatctaatctagtgcggtcccttcatcaggtgagaattattcatctcattttcattttagcccttctgaattaatgacattgaagcccggcagtttggtcctaagatgggtttaattatgtacagatactctttctataatggaaattgctcagataactaattaaccacaagaatacactgtctatggaaaatttcaggagcaccgtctgtggaaaaactgggaagggcatgctgtcaccacagctctggggtctattaaaagtgtggttatgcagcactggtgtctagtggggtgttggctctcaactgccagaattcccatagcatttcatggcagaaagtcaaggtgtccagcaatactctgaaagtgacctgttgattaaagtcgtcaattctgaagaaagagactgaaataagacaaatgggtcttaactttttttctctttctctcttttgtaaaaatgtgtgattgttctggcatgttcccaatccccacataatgccaacatcttttcttaaagggggattccctttatccttggatctgagaattattgcatgttctccctttagggacaatgaatgcagttgcatcacccttgcttttttttttttttttgtacacagcatgcttattcttggatgcagggacttgaaagacaaagccccacctggctttcacaacatctcctattagtaggtgtgccttgtgtgtaatttgaaggaggcggtcccttagctgtgtttacactgtacttttaaatgtggggctgaaggtagaatcaaccatacttaagatgccacctgggaaaatagggttctgtgtcatctcagccccacccatttgcaaatgacttaacagcagcactattagggttcctagtgtgagtcatttgcatttggactggtgaacttggtgacttcttggtgtttggaaacaaacaacctttgcagtctttcgtaaaaagcctgaacagtggaccagtctccagttctacttgcaaagctgcccccatcaaatccctcataatgttcaacttaaaaaatgttacacttttctctggaaatctaaccttttttccttttttaaaagccattttaagtacttcagtcttgaatcaaatgatcccaaatattggacaccaacctagaaattgggttacctcctgggaastttatcgaagaagagagattttggttggagagggggttttgatgtttgatacttatatttactattttaatatttcattgttgttgttgctgctgctgctgtattattttgcgagtttcgtttgtttaaatttcatggtatttggtaggagagagctggatctgttggtttcaggacaagtctagaaataagaaatctgccttgagtgagtgagttggttccctctgttgctatttcaccattaaggacsaaaggaactcacaaggaccagagacatctggctgaaagcaatactagtgtgactggacatctactacctgccatagttggtcatatcgtttccagtatgattctgattgagtgagtgatattaggctatgttcagggatcagggaggctaattatgcttatattgccttgtagcattttggtaagaattaatgattgtgtagatgtccagatttaggtcagcaatattctaaaagttctcattgaactaatcatgtttataagtagcctgtactttctatcataataacaatagtggaaaagctagttgacataaaaggagcccagattttacttaagtaaaaacacaaaagcaaagatattttcccacataaattacaaaagcaaagatattttcccacataaatgtccccataaaacaagttgaaccaaagaggaaagatgacaggtaaccgtatgacacgctaagaaagtatcataatacttaagttaacttcaaccttttatttccttatcctaagcagcctcttttctctttatcatttagtcctgtgcttctcaactttgataagtaaaaaagttattgcactaaataaatcttattgaaatgcaggatctgattgagtgggtggggtaggtggaatgagggtggggaagttgagattctgcatttcttagaagtttctactttatgttaaaatggctaatccatctcaacattgagaagtaaggtttcacttaatttcagcctgtgtaagtttatcccatatgtacatttcctaaaactctaatctcaggccccaggaatttctcctttagttaaaatatttttaggaataaatttgaattgcattaatacacaatttataaatttaacacaaaaaattatttgaagtttgagactttaggttgcatgaaatcaatttcatacttgaaaattttctataaattcaaaagtctgtgtatttaaatacaatttaaatacctgtgttacagtgacatttgtttttctgtctctctctccaccatttccagagtcatcatccctgtacagaaaaatttttcccacatgatttcaccataaattcattaaatatgatgcttacttgataatttctccaggttctttttttttttaattatactttaagttctagggtacatgtgcacaacctgcaggtttgttacatatgtatacatgtgccatgttggtgtgctgcacccattaactcgtcatttacattaggtatatctcctaatgctatccctcccccctacccctactccatgacaggtcccagtgtgtgatgttccccaccctgtgtccaagtgttctcattgttcagttcccacctatgagtgagaacatgcggtgtttggttttctgtccttgcgatagtttgctcagaatgatgtccttgctcactgatggacatttggttggctccaagtatttgctattgtaaatagtgccgcaataaacatacgtgtgcatgtgtctttatagtagcatgatttataatcctctgggtatatacccagtaatgggatggctggctcaaatggtatttctagttctagatcctagaggaatcgccacactgtcttccacaatgtttgaactagtttacagtcccatcaacagtgtaaaagtgttcctatttctctacatcctttccagcacctgttgtttccggactttaatgatcgccattctaactggtgtgagatggtatctcattgtggttttgatttgcatttctctgatggccagtgatgatgagcattttttcatgtgtcttttggctacataaatgtcttcttttgagaagtgtctgttcatatccttcacccactttttgatggggtcatttgattttttcttgtaaatttgtttaagttcttttagattctggatattagccctttgtcagatgggtagattgtaaaaattttctcccattccgtaggtttcctattcactctgatggtagtttcttttgctgtgcagaagctctttagtttaattagatcccatttgtcaattttggcttttgttgccattgcttttggtgttttagtcatgaagtccttgtccatgcctatgtcctgaatggtattgcctaggttttcttctagggtttttatggttttaggtctaacgtgtaagtctttaattcatcttgaattaatttttgtataaggtgtaaagaagggatccagtttcagctttctacatatggctagccagttttcccagcaccatttattaaatagagaatcctttccccatttcttgtttttgtcaggtttgtcaaagatcagatggttgtagatgtgtggtattgtttctgagggctctgttctgttccattggtctatatctctgttttggtaccagtaccatgctgttttggttactgtagccttgtaatatagtttgaagtcaggtagcgtgatgcctccagctttgttcttttggtttaggattgtcttggcgatgcgggctcttttttggttccatatgaactttaaagtagtttttttccaattctgtggagaaagtcattggtagcttgatggggatggcattgaatctataaattaccttgggtagtatggccattttcatgatattgattcttcctacccatgagaatggaatgttcttccatttgtttgcgtcctcttttatttccttgagcagtggtttgtagttctccttgaagaggtcttccacatcccttgtaagttggattcctaagtattttattctctttgaaacaattgtgaatgggagttcactcatgatttggctctctgtttgtctgttattggtgtataggaatgcttgtgatttttgcacattgattttgtatcctgagactttgctgaagttgcttatcrgcttaaggagattttgggctgagatgatggggttttctaaatatacaatcatgtcatctgcaaacagagacaatttgacttcctctcttcctatttgaatatcctttatttctttctattgcctgattgccctggctagaacgtccaatactatgttgaataggagtggtgacagaggacatccttgttttgtgccagttttcaaagggaatgcttccagcttttgcccattcagtatgacattggctgtgggtttgtcgtgaatagctcttattattttgagatatgtcccatcaatacctagtttatttagagtttttagcacaaaggctgttgaattttgtcaaaggccttttctgcatctattgagataatcatggtttttgtctttgattctgtttatatgatggattatatttattgatttgcatatgttgaaccagccttgcatcccagggatgaagccaacttgatcatggtggataagctttttgatgttctgctggattcggtttgccagtattttactgaggatttttccatcgatcttcatcagggatattggcctgaaattctctttttttgttgtgtctctgtcaggctgtggtatcaggatgatgctggcctcataaaatgagttagggaggattccctctttttctattgattagaatagtttcagaatrgtaccagctcctccttatacctctggtagaattcagctgtgaatccatctggtcctgatggatttttttggttggtaggctattaattattgcctcaatttcagagcctgttattggtctattaagagattcaacttcttcctggtttagtcctgggagggtgtgtgtgtccaggaatttataaatttcttttaggttttctagtttatttgcatagaagtgtttatagtgttctctgatggtagtttgtatttctgtgggattggtggtgatatcccctttatcaccttttattgcatctatttgattcttttctcttttcttctttattagtcttgctagtgatctatcaattttgttgatctttttaaaaaaccagctcctgggttcattgattttttgaaggagtttttctgtctctatctccttcagttctactctgatcttagttatttcttgtcttctgctagcttttgaatgtgtttgctcttgcttctctaaattgtgatgttagggtgtcaattttagatctttcctgctttctcttgtgggcatttagtgctataaatttccctctacacactgctttaaatgtgtcccagagattctggtatgttgtgtctttgttctcattggtttcaaagaacatctttatttctgccttcacttcgttaagtacccagtagtcactcaggagcaggttgctcagtttccatgtagttgagtggttctgagtgagtttcttaatcctgagttctagtttgaaagcactgtagtctgagaggcagtttgttataatttctgttcttttacatttgctgaggagtgctttacttccaactatgtagtcaatttttggaataagtgtgatgtggtgccgagaagaatgtatattctgttgatttggagtggagagttctgtagatgtctattaggtccgcttggtgcagagctgagttcaatttctggatatctttgttaattttctgtcttgttgatctgtctaatattgaccgtggggtgataaagtctcccattattattgtgtgggagtctaagtctctttgtaggtctctaaggacttgctttgtgaatctggtgctcctgtattaggtgcatatatttttaggatagttagctcttcttgttgaattgatccctttatcattatgtaatggccttctttgtctcttttgatctttgttggtttaaagtctgttttatcagagactaggattgcaactcctgcttttttttgctttccatttccttggtagatcttcctccatccctttattttgagcctatgtgcgtctctgcacatgagatgggtctgctgaatacagcacactgatgggtcttgactctttatccaatttgccagtccatgtcttttaactggagcatttagcccatttacatttaaggttaatattgttatgtgtgaatttgatcctgtcattatgatgttagctggttattttgctcgttagttgatgcagtttcttcctagcctcaatgatctttacaatttggcatgtttttgcagtggctggtactggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagagtttctgccgaaagatgctgttagtctgatggacttccctttgtgggtaacctgccctttctctctcgctgcacttaatgttttttccttcatttcaactttggtgaatctgacaattatgtgtctttgagttactcttcttgaggagtatctttgcrgcattctctgtatttcctgaatttgaatgctggcctgcctcactagattggggaagttctcctggataatatcctgcagagcgttttccaacttggttccattctccccatcactttcaggtacaccaatcagatgtagatttggtcttttcacatagtcccatatttcttggaggctttgtacatttctttttactcttttttctctaaacttctcttcttgcttcatttcattcatttgatcttcaatccctttcttccacttgattgaatcagctactgaagcttgtgcatgtgtcacatagttctcgtgccatggttttcagctccatcaggtcatttaaggtcttctctatgctgttttttctagttagccattcgtctaatgttttttcaaggtttttagcttctttgctaaaaggttcaaacatcctcctttagctcggaggagtttgttattactgatcatctgaagccttcttctctcaacttgtgaaagtcattctctgtccagctttgttccattgctggcgaggagctgcattcctttggaggagaagacgtgctctgatttttagaattttcagcttctctgctctggtttctccccatcttattggttttatctacctttggtctttgatgatggtgacgtacagatggggttttggtgtggatgttctttctctttgttagttttccttctaacagtcaggaccctcagctgcaggtctgttggagtttgctggaggtccactccagaccctgtttgcttgggtatcaccagcagaggctgcagaacagcaaatattgcagaacggcaaatgttgctccctgattgttcctctggaagcttcgtctcagaggggcacctggccgtatgaggtgtcagtcggcccctactgggaggtgcctcccagttaggctactcaggggtcaggaacccacttgaagaggcagactgtccattctcagatatcatattccatgctgggaggacccctactcttttcaaagctgtcagacagggacatttaagtctgcagaagtttctgctgtcttttgttcagctgtgccctgcccctagaggtggagtctacagaggcaggcaggcctccttgagctgcggtgggctccacccatttcgagcttcctggctgctttgtttacctactcaagtctcagcaatggtggacacccctcccccagcctcgctgctgctttgcagttcgatctcagactgctgtgctagcagtgagccaggctccgtgggcatgggaccctccgagccargcctgggacataatctcctggtgtgccgtttgctaagaccattggaaaagcacagtattagggtggggagtgtcctgattttccaggtaccgtcagtcatggcttcccttggctaggaaagggaattccccaaccccttgtgcttcctgggtgaggtgatgccccaccctgctttggctcatgctccgtgggttgtacccactgtctgacaagccccagtgagatgaacccggtacctcagttggaaatgcagaaatcacccgtcttctgcrtcactcacgctgggggctgtagactggagctgttcmtatttggccatcttggaacctccctttccaagttctttattacagagtgggtcactgaaacttcatggaacaaattggaaattatcttcttaattaatgtcactgtctaccatgtatgggaatttggtaaatattatatggtttcaataacatagtagatagaacattgtcaaatctaaacttcagtgaattgtaacagatcccacctgaaattctaaagaaaacagaattctaattgaagaggttaaacttttacagggaatgtcaactgccatttgggtcctgtaaacaaaaaactgttttttaaaaaagtaaactttaaaagtattttcagatgacctcatttgctatccaagtggcttgagtatgcttgatgctaagacttctttgttacagactggagatgtgtgctactggggcagtgttgctctgtgacaaggaggcagaggatgagggcaaggttcgatgtgactgtgaattctgggtggctctggctatcgggagccttcattgattacagcaaaacagttgctttcctagggcaatagtgtctctgtcacccaggctggagttcagtggcatgatcaatcgctcactgtagcctcaacttcttagactcaagtaatcctcccacctcagcctcccaagtagctgaaactacaggtgtgcacaaccacacctaatttttttaatttttaagtttttgtagagacatggtctcactgtgttgcccaggttgatctcgaattcctgggctctagtgatcctcccgcctcggcctcccaaagtgttgggattacaaatgtgagccactgcacctggccctttgcaaccttcttgacaatgcattcctttattccctaactggaagtaacttctttctctttataaaattgtatctgtaccttttctgggtcatttctacctttatattctagttacgtatgtcctacctccctcctagggagggaggtaagtaagactggaaagtagacttcatgtgtgatgaatgaatgaacaaaaggaagtctaacatatggatatagtcaactggatgcaaattaaaaatttttaaatattgatttgcaagatttcattaaggtcaactcttaatagtttgtatcatatatgttaggaaccaaatattaataacttcttcagcattaccattatctttataggactgtctaaaatgagcagccatatctttaaactgtgttttctctgattacacgctcacaggtaaaacccaaaggggctgggaacaaacaagacttttttttttttctgtatgcctgaattatctgtactgttgcttgttttcccacctttggccatagaaacttagttctaacatgctacaatttttgcagttctttctcttagaaaaagaccacattgtctgaaatttcatccatttaagtaatcaagccttaaagttgaaggatcttggtcatgattaatctagacctacaaagtagtatcttaatggcactccttttagaaagttaggttccaggacacacatagctgcagtgtccacattttgtaagctccttcgttgtcacagccactctcttctctgtggctgatattctaaaactggcaacacatcctgatggtaaaagcttggttcaggagacaggtgacctactagctttatggcatttgacaggttacctaacctctctgacgcataattgcctcatctatataatggggataataatacccatcctgtctccttgtaaaaatcaaattagatgacgcctgtgaatgttctatagtctcttagacaaatgtaagttatgactacagcaagagtaaaagagcatgttgttatggacattctttcagtgaaatgtctaagacttgtgagtcacacttaaagctaaacttgatatctacttcattgattttctttttagttctatgtactatattgaatttcctgacagtggggctatgaaagccttcctagcattttatagatgtggttgaattaatggctgtaagccttaaagcagaattagacagcatcaatgaatttattaagtataaataaatatataatctgcttagcaatattacacagcctctttatcttatgtgtgataaagagtcatccgaaggttgaaaatgaagaattgtcctggaagctcttacttaatcttttattatttcctaatacagtatataaaattactcattgaaagcttagcagaataagaaacaagaagttaaaaggctgaaaactacaaattttgctattattattgttattacttcccaagtctcttattgatctgttagaaatagagctacacaggaaattgtaggacagttagtaygtggtagtgttatctgctttttaattattcaagtaaggttttattccattagaggaactcaagaagttggtcatggctgataattgctatctgtcaaattccttagagcagggatccgcaacacccaggccatggattgttaccagtccctggcctgttaggaaccaggctgcacagtaggaagtgagcggcgggtgagcaaacattgccatctgagctctgtctcctttcagatcagcagcagcattagattctcatagaagcatgagccctgttgtgaactgcacatgcaagggatctaggttgtgtgctccttatgagaatccaattccttatgataatttaactgatgatctaaggtggaaccatttcatcccaaaaccatccaccctgctactcccagaccgtggaaaaattgtcttccacaaaactggttcctgctgccaaaaaggttgggaccactgccttagagtttataatttggggttagcacagcctatatttacctgagaatttcaatgggttcactgatctttccaaatgaaaaggcttcttacgaaaattatatccaaactgtcttttctcttagtttaataaacctatcagtaagtttttactgagtactgctattacatttttctctgttaagcattatgggggctcagacatgatccattccctcaaagaacttacctttcagctgaagactgactagaatgagcaaatacggttaacaattaacaagtgagtaggccagctcggccaacatggtgaaaccmtgtctctactaaaaatacaaaaattagccgggcatggtggtgggcgcctgtaatcccagctacctcctgctgaggcaggagaattgcttgaacccaggaggtggagattgcagtgagccragattgcaccattgcactccagcctgggcgacagagcaagactctgtcttgggaaaaaaacaaaacaaaacaagtgagaagggaatcaagtactacgtaagatgtaatgtggaattttagggaaggaaggcagtgtatgctggagtaattagagaaaggggcatgcatgatttgatgcttgaactggatcatgaaggataagcaagattttggcagcaagtgagagggagagaggagtttgtcagaggaatggaacaagtcaggaggcagtaatgtgtacggcactccaaggactctgtcctgatcggagcagaagtgatgaagcattgagtagtttgagaaagttagctaagaagggtgagggcagatgttggagagagttgagtatcagagagaagacattagatttgagcagatagaacaaaaatgccattgccagtttttgtgtaagagaatagtattagggtggttacccaggaagtggtcatcagagttgaatggagcagaaagagtgtctgatacagcatcgggacgttgtggtcacaaaatgaggtggtgagggctgagccaagatggtggcagtgggatggataaaaagggatggccaggacaaatattttaaaggaaaaattaacaggacatctttactgactggattggaaggctatgcaggaaatatattgtcaaacttgattccaggatttctatcctatgcctgggttgcccaaaatatcagggaaccattgttagaaaaggtaggagataccactgttccaacaaaaagtattgagtttggtgttgcacccacttaacttcaaggccttacaagtgagtagacagttagttagaattgcagaagtgccactcagagagcagggcttgcaatgtggggttggactttgtcaccattgtgttaattcctaattctatgcagatgctcagcttgaggaatacccatgtttgggcttcagaatgaaagccaagtaatatttactcagatgccaattttccctctgaaatatttgctcatggaactgagagaacaatatataaagcattaattatttttctcataaagttattaataaaaagataagatcagtgaaaggcagagtaaactagaagccaagtatagaaaatggtatcattcaaagactcattactgtagtggtgaaaacaaaacaattttccaacagcttaagatgcctcagtattttggaccatttttaagtagttagtgtgggcacttagtaaatatgtattaaactatagttcattaattcttttttttttttttttgagatggagtttcactctggtcacccaggctgcatttttgctttcttagtgatatataaaatgtcgagtttcacaatgatggtatcttagatttgattaaatatggtattaaaaaatagctgatcacagaaagtctctaccagtgtgatgtagatggctaaagtattccacatttgcaaacttttattgacctaaataagaggtgccccttgggttgtttttatttggactgggaatattaggagaaagctttttcattcagtgtgtaagtacaatctaccagaaatagaaacccccatggacgatctatttctttgatggtacaggactcagaacattcacaaagatttagttgttagcggaatagacatctgtattttattcaaaccaattttcccttcctaatctgagaacattgtgcaatctaagcagttctaagcatgtttgctattcgtgcaaagtgagagtaaatctaaaagaaatttttttgtgtgtttagggatggtaataaagtctcttagtggttgaaaatgttatttcttacaaaagtggagaacatttgcttttcaataccagagttttcagccatttctgcattctgacctattgactggaggtaggttgcctttgaattcagtaaaacttcatgggcagaaacacagttccttttcctacttatttggatatcatgatggccattgcatgtatgtgtctttttgtaagtccatgcctcagaactgagaagtaggaataaaattagggtcagggctggggatgctactctttgctgctgagaaacacaatgcttcaggtaagtgattctgaagtccttcaccacctgacggtaaccttgggttggtccataggtatgttttcattttgcttgttcatccattttaattggcttcctagagcatgcttgtagatgtaragccaaatttagagtagagcaaccctctggcaaacaggaagagattaattttgtggtatgcttttaagggacttcccaggaaacttcaaaagcagaaaaagaagcactagctgcctattccaaaatgtgtaaaacaccactcagctttttaaaagtaggataaactcagagcgcgcgcacacgcgcgcgcrcamacacacacacacacacacavagagracatctctagtaaaaagaaaagttgagctttcttagctagatgtgtgtattagccagaaaaagccaaggagtgaagggttttagagaactggaggagataaagtggagtctgcatatgggaggcatttgaaatggacttaaatgtctttttaatgctgactttttcagttttctccttaccagacacattgttttcatgacattagccccaggcatagacacatcattaaaatgaacatgtcaaaaaatgatttctgtttagaaataagcaaaacattttcagttgtgaccacccaggtgtagaataaagaacagtggaattgggagccctgagttctaacataaactttcttcatgacataaggcaagtcttctatggcctttggtttccttacctgtaaaacaggatggctcaatgaaattatcwttcttctttgctataatagagtatctctgtgggaagaggraaaaaaaagtcaatttaaaggctccttatagttccccaactgctgttttattgtgctattcatgcctagacatcacatagctagaaaggcccatcagacccctcaggccactgctgttcctgtcacacattcctgcaaaggaccatgttgctaacttgaaaaaaattactattaattacacttgcagttgttgcttagtaacatttatgattttgtgtttctcgtgacagcatgagcagagatcattaaaaattaaacttacaaagctgctaaagtgggaagaaggagaacttgaagccacaatttttgcacttgcttagaagccatctaatctcaggtttatatgctagatcttgggggaaacactgcatgtctctggtttatattaaaccacatacagcacactactgacactgatttgtgtctggtgcagctggagtttatcaccaagacataaaaaaaccttgaccctgcagaatggcctggaattacaatcagatgggccacatggcatcccggtgaaagaaagccctaaccagttttctgtcttgtttctgctttctccctacagttccaccaggtgagaagagtgatgaccatccttttccttactatggttatttcatactttggttgcatgaaggctgcccccatgaaagaagcaaacatccgaggacaaggtggcttggcctacccaggtgtgcggacccatgggactctggagagcgtgaatgggcccaaggcaggttcaagaggcttgacatcattggctgacactttcgaacacrtgatagaagagctgttggatgaggaccanaaagttcggcccaatgaagaaaacaataaggacgcagacttgtacacgtccagggtgatgctcagtagtcaagtgcctttggagcctcctcttctctttctgctggaggaatacaaaaattacctagatgctgcaaacatgtccatgabggtccbgcgccactctgaccctgcccgccgaggggagctgagcgtgtgtgacagtattagtgagtgggtaacggcrgcagacaaaaagactgcagtggacatgtcgggcgggacggtcacagtccttgaaaaggtccctgtatcaaaaggccaactgaagcaatacttctacgagaccaagtgcaatcccatgggttacacaaaagaaggctgcaggggcatagacaaaaggcattggaactcccagtgccgaactacccagtcgtacgtgcgggcccttaccatggatagcaaaaagagaattggctggcgattcataaggatagacacttcttgtgtatgtacattgaccattaaaaggggaagatagtggatttatgttgtatagattagattatattgagacaaaaattatctatttgtatatatacataacagggtaaattattcagttaagaaaaaaataattttatgaactgcatgtataaatgaagtttatacagtacagtggttctacaatctatttattggacatgtccatgaccagaagggaaacagtcatttgcgcacaacttaaaaagtctgcattacattccttgataatgttgtggtttgttgccgttgccaagaactgaaaacataaaaagttaaaaaaaataatamattgcatgctgctttaattgtgaattgataataaactgtcctctttcagaaaacagaaaaamacacacacacacacaacaaaaatttgaaccaaaacattccgtttacattttagacagtaagtatcttcgttcttgttagtactatatctgttttactgcttttaacttctgatagcgttggaattaaaacaatgtcaaggtgctgttgtcattgctttactggcttaggggatgggggatggggggtatatttttgtttgttttgtgtttttttttcgtttgtttgttttgttttttagttcccacagggagtagagatggggaaagaattcctacaatatatattctggctgataaaagatacatttgtatgttgtgaagatgtttgcaatatcgatcagatgactagaaagtgaataaaaattaaggcaactgaacaaaaaaatgctcacactccacatcccgtgatgcacctcccaggccccgctcattctttgggcgttggtcagagtaagctgcttttgacggaaggacctatgtttgctcagaacacattctttccccccctccccctctggtctcctctttgttttgttttaaggaagaaaaatcagttgcgcgttctgaaatattttaccactgctgtgaacaagtgaacacattgtgtcacatcatgacactcgtataagcatggagaacagtgatttttttttagaacagaaaacaacaaaaaataaccccaaaatgaagattattttttatgaggagtgaacatttgggtaaatcatggctaagcttaaaaaaaactcatggtgaggcttaacaatgtcttgtaagcaaaaggtagagccctgtatcaacccagaaacacctagatcagaacaggaatccacattgccagtgacatgagactgaacagccaaatggaggctatgtggagttggcattgcatttaccggcagtgcgggaggaatttctgagtggccatcccaaggtctaggtggaggtggggcatggtatttgagacattccaaaacgaaggcctctgaaggacccttcagaggtggctctggaatgacatgtgtcaagctgcttggacctcgtgctttaagtgcctacattatctaactgtgctcaagaggttctcgactggaggaccacactcaagccgacttatgcccaccatcccacctctggataattttgcataaaattggattagcctggagcaggttgggagccaaatgtggcatttgtgatcatgagattgatgcaatgagatagaagatgtttgctacctgaacacttattgctttgaaactagacttgaggaaaccagggtttatcttttgagaacttttggtaagggaaaagggaacaggaaaagaaaccccaaactcaggccgaatgatcaaggggacccataggaaatcttgtccagagacaagacttcgggaaggtgtctggacattcagaacaccaagacttgaaggtgccttgctcaatggaagaggccaggacagagctgacaaaattttgctccccagtgaaggccacagcaaccttctgcccatcctgtctgttcatggagagggtccctgcctcacctctgccattttgggttaggagaagtcaagttgggagcctgaaatagtggttcttggaaaaatggatccccagtgaaaactagagctctaagcccattcagcccatttcacacctgaaaatgttagtgatcaccacttggaccagcatccttaagtatcagaaagccccaagcaattgctgcatcttagtagggtgagggataagcaaaagaggatgttcaccataacccaggaatgaagataccatcagcaaagaatttcaatttgttcagtctttcatttagagctagtctttcacagtaccatctgaatacctctttgaaagaaggaagactttacgtagtgtagatttgttttgtgttgtttgaaaatattatctttgtaattatttttaatatgtaaggaatgcttggaatatctgctatatgtcaactttatgcagcttccttttgagggacaaatttaaaacaaacaaccccccatcacaaacttaaaggattgcaagggccagatctgttaagtggtttcataggagacacatccagcaattgtgtggtcagtggctcttttacccaataagatacatcacagtcacatgcttgatggtttatgttgacctaagatttattttgttaaaatctctctctgttgtgttcgttcttgttctgttttgttttgttttttaaagtcttgctgtggtctctttgtggcagaagtgtttcatgcatggcagcaggcctgttgcttttttatggcgattcccattgaaaatgtaagtaaatgtctgtggccttgttctctctatggtaaagatattattcaccatgtaaaacaaaaaacaatatttattgtattttagtatatttatataattatgttattgaaaaaaattggcattaaaacttaaccgcatcagaagcctattgtaaatacaagttctatttaagtgtactaattaacatataatatatgttttaaatatagaatttttaatgtttttaaatatattttcaaagtacataaaatctgggggttctgggtttttttctctttactgtaaaacaaacatgaaaacgtgttttattataaatacgtgtgttccttgctttaagactaatctgactagttttagtaattaaacagccctccagagaggatacttatttgaaagcctgggaggccaatcctgcagtctgtgagcttctgagaagttgtaggattggatctgtcttccatggtggaagatgggagtgtcattttctcggacacttgaaagttttacccctttgaagtgatatactttcatcagataccaaaccatgtatcctagcaacatcaggatccacgaatcacggctggctggctggctctatttgactataaaataactgttaaaaaaaatcaaagtaggtttacttagggataatgagaataaattggcccaaatttagaaagtcaagtactggggaaaaaagtaaaaaaagaaattcaatatttggagacaggtcacatatcctcggtttggaagtggtgccatttgcagtatgtatttgtatccatagcactgatttaatttttgtacgtggagcacacagattttatatcatagtacccacaatctaacagattgctaggatttctaaaaggatttgcctccgtgatggctgccaagccgctgggtaatttagttaaagtgtttaaagttatcactaaatcttagggaaataaatggaaggattttaaatcagagaaagggccattaaggaaaaaaagcatctgttcttactcttcagcctccccatttgaacactgacaacccatcccataacgtggtgaactatatctgtgcaatgtatcatttctatttctaaacatacacacatggtttcctcttgtattgtcttataaataaggatcaggaaagtcataacaaacattgacttgtgttgtgtatatggaaaaacagatcgaatgagatgaattactctatcctaatctgtccagtgaacttgaaaagtactctaagagaagcccttgactgccagtcatgacagcccagccatggacttagaactttgataaacttcaggcttgaccaattttcatagtcagaggactaaaatattttttaaatggttgagtaaaaaaagtaaaaattaaacatgacatccaaattacttgaagttaaacgagtttggtaaacatgactgaaagttttcattagaagatgaggttggagaaaaaaacaaaatagagacatctactaaattatcctacttggagttaataggagtaaccaatgtgtactgcattcattgagtaagcagttaaacttgtttaattactaagatgccaggaaataactcagatcattgctttgatctgttgtttttcaccatactgataagcctctgtggtcattagctgtgtctatgaaatctttttatgagctgtactaattcagtgaataataagacagttcgaaatgagaatctgaactaagtcttagaatgggtcagtgttaaattgttcctcattcatttaagtgacttctagatctggataaaatgtcaaacactttttgaactgcaacaaatggcttcaggcattgcctcagttcagccagcactcccaatagtgttaaggtttaaggttattgtaaaacatacttgtctccatcatgttctaacatcaagcctggtctacaagttaaagtagaaatggctgcatattttgataagccattgttaaataaagactgttaattgggataagaaacaatatacgtgtacataaatttaggaagatgaagcatttagcttgcaaaaagccattcacagatttgatccaacctcagaatgttgaccagcaaaattagtattttatggaacataggccatccttttagctgtgggtttttaaactgtggttttaaaggttggttggctgcttggtttggtgacaagcgggggtaatggttgggaatctgacttttgttggttacattgaactaactggtggttggtgaactccccacctaatagctaaacttagcaactagagtaggtgaagccactccaaaccagcccatgtttatggacattccttctaataaacacactgcctgcatgtctatccccaatcttgtgagtatgatcatccattctctcaattctggccaccatttgaattatttgtagggaaaaaaaagcaaactccttgctttttaatatgtgattatttgcagtaaattacttgaagactatgtttaaatattaacagaaaaagcactgtgatcttacacattatcataattgagaagacccatttctgtggcactctgtaggatttccataggcctttacctcacccccacaccctaattatttacaaggcacagaccaccagattaggagctccccagcctggcatttgcttttctaacaacaatcctgtgtgcttggtaatgtcagtagcatggaattgtaaaaagcaggccttccaattaaacctcaccacacaaacaataaacaagacctttgcatttaagtgtgagctgctattttatatctggaaaaacaaaagtcctttcctttagaaaaataagcttatctgtcctgaaaaaagcctcacacataatgttgtagttaatgacaggacttgtctcaagcctgtaaatgaccaaaaagtgttagttgaaatcctgagcttgaggtgtatgttctacatttagaaaggacataaagatgcttctgcagctctgcactttggtactgtactctatttcaaatggttccttagaaaccaggggctggtctgcatagaatggctgaacccaggggaaatatttttgtctggcttaagtgctcacaatttgaaaaaatccatgtcaagtactgcagtacacatttaaatttatttagtgaagctgcattctccattgagccctaacatttaaaaaatagttgctcaactgggatttggtgcatatcaggaaggaaagaggaaaaagacataaaatagaaaccttacccagcagagacctgctccaacagataccaagcagtgtttacttggagataacagtacccatactctcctccagttagactcatggaatgatctcaaagtgtgttctgcaaccagcatctgcatctctgggaactttttacaaatgcagactctcagttcccatcctagacttactaaataagaagctctgggggtagagtacaacagtctgagttttaacaacccctctaggtgattctgtgcccactcaaatttgaggatcattggactaaggggattaaacagcctttcacatgttctagataataggaagatagcacaacccaagaatttgaaactgtagatctgatcccaatcatgtcactacctatttgcttggccctgaaaacatcaaactatctatgtttgcatttcctaaacaacacaaaagtgatgggtgctcgcaggtggagcaaggcttagtgttgtaagagaagagtgcactgatggtttgaaagtgagcatgcaaatgtgagccaggaaagctcagtgcccttcatagtcaacaatttttttttctttcaaagcaacagcagtagtggattcaggacccagagcacgtagtcgtttgtaacacatttggaacgactgtgagaaatgagaagcaacatgcagcaaattaataaggaaaagattattccatctggggagctggtctctgcacatgccaacacagcccattctctgtgaaatagcgttttataggtcacaaattaaatcagcatcctgaattaatcagctattaacatccagctgaggaaatctaggttcacacctctagaatgaccagactataaatacaaagggcttcctcagactttgtggcaaagcttttctatattgtaggaactggtttctggaaatgaggacctgaacatagctattcccatctctgtgtgtatgtgtatgtgtgtgtgcacactcctgcacattttacaaggcaaattgcattagaagatttttctatttctaggatggaggggagggtgtccaaatgtattacccatccattaggcaatacagaagcctgaattctaacaagcctaccttgggagccaggtatcttggtagttcaatcatcaggttggccaaccctttccggtatctgaacctccatgccctcaactgtcagaggaagaggctgaacttgggggatctcccaagaggatggtcttggaggtaaatttcagttttaatattacaatttcattcttcctacttcattatttgccataaaaagagattaaagaggtttctgaagcacttaaaggctgggaagcattctgagataattcactgtgcatctcctgcctccctccatagctggtgtccttatatcatggtacttgccacaagattaaaagcaggaggcaccttgggttagtgtggcggttggggaggatgtgaccaaaggaaggtttctacttcatatgcaactataaaaatattaccaactgtctgacaagcaggcagaaaataccttggggaaggtgcccatatattcctcaagatgcaaattttctaccagggtctaaccttactttcaaagccaggcaatgtatttacctttgttttatgtcactcattcttactgtattacatggtgcctggcaaggagagattccttgtgttttgccaagttgcagggtcaggaaactctgcatgaaactgctggattagcatcctgtagagtcactgttaacagagctctttgaatgaaatgggtttgcatctctgttctttggggctttataaattcaccaaggatgtacggttcccaatctgtttcaccaccacctcccgagtactctggatagttcctcctcctgagaggatggccttgagaacaaaagtatctcataacaaatcacagcaacaccacattcagcagcagatttcctcagagaaacagcagatatttcagaatggtaaagaggtcattctgagtggagctttggctagcttaggagacaaacctcactggcatgccagtgtttgaaactcctcatttcagcaatccaactttggtttattcctggccctgagtcctttgtgcctgaatctctgagaaatctatgtttttgttcaatccacctctgctcccacttcatgccctgctttccttcctgatgacctcagagctctgcttcctctgggatccaacatctcaccactcagggggcacataatatagtaaagagtggagtctgaatcccaactctgctacaagagctgtgtgactgtaggcaagtcacttaacttctctgtgcctcagttcctcacctgcaaaggacaggtaaaaatattcccacttacctcatgggattttgtgacaattaaatgaggtaatacatataaagcacttaggaaagttacagacccatgagaaagcctcagaaaatgtttacaaactcttggaagtcactctgctgactggtaataagctgggctcatctagtacacacttcagagactcttttctcatattcagactcctggaagagatcccatctcatctgtgccattagcatccagggtcactttgtcttttctggaagactcagagagataactcttgtttacccactagcaataatactgcttggcagttaaactgtggccactacatacactcaagcaaatggaagagatatactacaataaagggtgtttttctagactgtacattccaaatgaagcccattattcctaagtgtctatcccagctgaatggcaatgactgaagccagggtgaaatggatgaactcacatagtctgaaagaaacaaggggccacagtcacatttctaaaaatagacatggcacatcaggaaaatcctacctcaacttctgccccatgtccttgacatacatttaacccattgcacaattatagtgactagtacttactataagcaggcagtgttcaaggcatcttatgcagattttctc

SEQ ID NO: 17717 - DNA, 46934 bp, Homo sapiens
tcaattgtatcatttatacattgtcaggcacatggactttaccttctatttttgtcagccttaactccacattgtttccattttacttctgcacttaaatacattcagtgatcaccagcaagttatttttttcaaaattttctctgtcatttctcagtttagctttttttttttttttgagacagagtctcgttctgtcgcccaggctggagtgcaatggcacgatctcaactcactgcaagctctgcctcccgggttcacgccattctcctgcctcagcctcccgagtagctgggaccacaggcgcccaccaccaggcccgactaattttttgtattttttttttttttttagtagagacggggtttcaccatgttagccaggatggtctggatctcctgacctcatgatccgcccgcctcggcctcccaaagtgttgggattacaggcgtgagtcaccactcctggcctcagtttagctttttgaaatttcctcaaagaggactcttgggaacaataatccctaaatttcttgcatattgacaccatttatagtttttggatttgaaggacaacttgaatgtatgtaatattcttagcttacatattctttccctgattatcttgtaggcattgctctactcttttctggtgttggtcatttctataaaatatctaatgcaagatacttttctcctttttaggtgacttgattattttgtgtggttgccagaagatttcctctttatctctaaagtctaataacattactgggatatcacttggttttgagtattctaagtcaattattcctagtacacaatgtgtcctttcaacatatgtcaggttgacttttatttgaggacctttattaaatgatgcctttaaatatttgttatactttggttttctttcttaagtactgatatggtttggctgtattcccattcaaatctcaatttgaattgtatctcccagaattcccatgtgctgtgggagggacctagggggaggtaattgaatcatgcgggccagtctttctcgtgctattctcgtgatagtgaataactttcatgagatctgatgggtttatcaagggtttccacatttgtttcttcctcatttctctcttgctgctgccatgtaagaagtgctttttgccttctgccatgattctgagacctccccggccatgtgaaactgttaagtccaattaaagcttttttatccccagtttcgggtgtgtctttatcagcagtgtgaaagcgaattaatacaagtacctactctaattatatgtttgttgatctattttttgtctgtcttcaacatttattatttttctaattcattctgtttataattttcattttattatatattttttctcatttctatattctaggtttcctactatgttccaggaactctgttctcccttgtgattttttccctctttttctgagttttgctacctcatatttcatcacttcctcttgtgtcttcatctcctcccttagttttttcacttctgctctgtgatcttccttcatagaggcaactgctgttttaatttttaaaatttaatttttgtcaaaatgcttggtaacaatgtttgtgcaatggcaatattttttggtggtggctcatgtattgattagttttgctgctctttcttcaatttgattggttttagtttttgcttatataagtttgtgttcatgctgtgttcgttttaaaactttcctcttttaattaattagctttaatgaggtgattttttttttttttttgcttgaaatatgtggtaaatccttgagtaagaggctgggatgtgagatcagggtatccttcaagttttacaacccatggggacagactgctttagcaaaaaatgactcatgtgtgtgatacaggtagccctgactcatctatttcaccgatccaaaccaggtcccagagagcttctgcttccaaccatgttcacctctttttagcatccatgtatataagggataaagcatttgtacttcatggtgagcctgtaactcacagtgactatttttttcccagcacattctaagatgctgctgctggccttcgtatactctctatacttttcactttttcttgggcaacttttgtcctatctcagctgttttgcttctttatattttgtaagctgcagattacatctctctttgagttttgcttaaagtagaatttatttgcaaagttattatctgtaattttcctggttgctttcatataatttccatgagaagaagaggaaagatcttgacttttgtagccaaggtctatataacttcctctctacagtatagtttacactggaagtggaaagtttttgtttcgttttgtgtttaatccaaatatataaagatgccactatactgtaaagtcattcaatgtttactttttaatttcatatgctttggttggtgtttaaagtgttcctaggtccagctccaaatttattccactttactttctttcacatattttatgcttcttttaaattgtactgaattattcagagttattctaatagtagttattatttttccttttttttttttttttttttttttagacagagtctctctctgttgcttgggctggagtgcgatggcttgatctcggctcactgcaaactctgcctcctgggttcaagcaattctcctacctcagcctcccgagtagctggcctcccgagtagctgagattacaggcgcctgccaccatgcctggcttatttttttgtatttttggtagagacggggtttcactaaattggccaggctagtctcgaactcctgacctcaggcaattcacctgcctcggcctcccaaattgctgggattataggcgtgagccaccgtgcccggcctttttttccatgctttattcaccttgtttcctccagttgacacttcctatccaacccttgccaattcttccccacctccatgtttcttattctcaattaaagtcctatctggaattcaagacctacctcaaataagtacctaattcttaaagctttttaaaaaatctttatatattgttataatatcttttacatgtttatacacagtttgcattgcttatattctcttggaatgatatcttattgtatatgatgttttggttatttgggtactgcttctagtttccaccaattggaagaaaggttgtgacttagtcatatttgtgcctcatttatgcctcaacacagaacattgtgtataatagacattcaataagcatttgtttaaataataaaattatgcaaaatgccaaaattattttctagaatgtatggcacaatttcctcctacttctcactgatgcgcaatataaccactcatggaaataatttggttcttttttttcctaaaactgcaaacccctatggacgtgattatagatgcgcttgtttattcatgcagacagtcaaactgtgttttgactattttaattgccttatttcaatacagaataattttttcttggctctttatgtcttgatagctgttaagtagattaaaaaacaaaaatggaaaacatgaacttctataatcctctacccttagaatggtggatttctattaagatatatgcattaaaagaacaaactctaccaaaatttaacttttagatgtaaattgcagtaaacagaatagcagaagcttagagaaaatttttccaaatacactctgtgttttagaaacaaagatttttagaaaaagcaaaatttgagaattttctccccactatttcatttaaataggtctcttaacaaatataattcacttgtgattttcctcatcattttgtagctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataaggtacagatataaaatgcagaaaaagcatcaagaattctgccttttattttattttatatttaaacttcaggaagttttctcttcatgggataatttagtactgcttttatctatcatctgtcaatttctctgtattcttaataaaataaatattgaactaaagtgggagcaacatcttggtatttattctcaaggatttttatataaaaactttatgattccagaacaaagttctaaccagttgcccttctggttgttcctatagacaaacacttttgatcagttttcattgtaaaacctgcattgaaatatatgaaaagtactgacggagtaaatatctacaaatgtgaataagaaaactgtttccacttttttacactttctagtagtttttaaatgattctcataatggtgattagactttgtcaatagcaccacttcctgttaattcttattggcttttattcattctataaacttattggaaaattactgcatatgatctacttcaatagtttgttatactgtactttaaaattgaatgccatagcacattgaagatgtaatagtcttgaaaaaaaatcaaagggcctggggctatataaaggacccactctatgtggaaagtcaagtgggaaatatttggttctttaacttactgcctctgtttgttgacccatttttatttacaaatataatcatcttccaggcaatattattattctgctttatttattgtgtcctatagaaagaattggtaaattcatttacataactataatgacttactgtatatttatattttaaagagtgctttcaaaaccagctaaagtttaagaagaatttttcaataacacatgtagtaaaggaaaataatttgcaataggtaggggaccacttggtatagcaactgcaaatgtccattgtgtttaaaccacacaataatcatatgaatatattagcttagagctaaaatatgagatgcgaatctattaggagagtgctcaattatcaatggcagagttgagattggaacccaggtctgttttactcccaaaccatggtatttgccattcatcattctgtacacttgcttcttattagtataaagccaatggaatgaattctaacactagactttccagcaccagtggagcaaatattttggtttggtggagaaggcggtgatggaaggactttcagaagacagctgcctattctaactacatttaagtgtattctgagttaggcattatgacttctattcatatcgcctttcctcctcatggaatgaaaattacatgcaggaaagattgtaggagaaaagtatatttgtctctgtgtgtgtgtgcgtgtgtgtttgtctgttgggtggtgtgatgatgtacaagaagtgtccttgttttagaaaaatataataatagaatgtttaagtatgatagaaattatgtttttagcttgctataaaatgattcagaaaatactaattatatgtatatataaaatgtatatatatgcacacacaggtaacacatatacatatctatatttacatctgtttgcttattgggaggatagatacatagatgaaacacacatgcggtagatgctaacaattggggaaagaggaggaggtggagatagcagttctttgaactatatctgcaacttttatgtaaatttgaaagtatttcaaggtaaatttttttaaaatataaaaagttgcttttgaacaaaaagattatttgagatgttcaagcagacactgggtaactgtctcacggggatattgcaaagacttcttgcactgggtaggaggtttgactgggtaatccatcatttcaaactcagagcacatgatttatgaatcataggttggtgatagtacaatggagtgaaatctgagccacatgcccagaaatttaatggaatgttaagatgttataaaagtagaatgcgggtaccaaataatttgcaaaggctcttttccccactgatccgtccatccctcatgtaagtattgaaggcatgtataagagattattttaggttccgggtattcacatataaatagaatgcaccttttctaccctcagcgttctgaagtgaagctatataaaatgtagtggtttattaagccaatactaaatgagcccactggcataagttggaaattcataatctggcatattttttccagtctaatttgggaattcttttgctagatatactttactgtttacccttgaagataactttgtttgatgtgatagcctgagatagtctggttcatacagacagaccttctctctatagcctactacatgtgcatggtattatgctgtaactctaattccatccttaattaacatcagggcttcttctgtaaaaggaattaagaagagctgtctcataaatatattcaatgagaagagaacttttaaaggtatgagactttcaaggtaactgtttctaataatttggagaaaaaacacaaaaagaagaaaaaagacaatgtctttttttctgtgtcttactcttcttttgtaactcacagcatctaattttctaggcaggtagcaggatctcacctgtcaactcttaacagaactgaaggcattayaaactgtttctgaaattaacattcagattcaattacttatgatccatttttctgtggtaaaaggaattggtcacattaaaataggatatgtcataattttcaataggctaccttgtttgtattacttatatttacactaaatataatttaacattttcttttgtcagaacattttcctattatcactcaaaatttaggaacaatcttaccaaaaaaaattgcctgaaatgagtccatgcttaaatggaagaattaacttttaagttctttactgatgagggcatttgcttatacatttttaaagtttggaattaagtgcacttttacttgaaaaaactataaaaggataagaaaattgatgagatgataactgtaaccctttgctgtggtttttatatatattcctaggcttatactttacagtcggacagtaatggcgatcaaccttctaccaagacacsttggctctcattaatgaataattctccccccaccccgattttctaggagcaaaatagaattgtagaaaaaagcggtttgggaaaatattttaaaaatttgtggtaatattttayggacaattgtattgtcgtcattgtctattaaaagaggttaaaccagggagaataaatttatggctattgctttttactcctcaagagacaggaaaatgaacattctgcctgaactgctctaatataaggtccttacagaacaatttcattaaatggtcttagtaggacagagtgacggtctctgccattggtaggaaaagtaatggactatttctggataaatcacattgtgatctgagcagtgtacagacataatgatgtggtagccaagggtactggtgatatatgtttgctggtgtcagtaaatgggtagaaaagcattgattgaatgatagtcttgacattcagacttaatatttatgtattgcagtgtgaagcaagtagaatgatagtattcttgtattgcacaactctttttggaaaattatctctgtgttaagttaaagctacactagagtgtgcttatgatagagtaggtaatattagaataaaactcaagatctagaaaacatttggagatgcctatatgggaaatcaaaaaattttagttaattagtagattatggcctataatgatctattctcaggcctatttttaagttatagccatgttaggacatggaaagatgttaacagggtcctctgacaagtttttaaaaatgaattccatttaaagctatctatattcactttatttcttttacatgagtttatcagaaatagtattaaatttggggatcaacagatatttaattaaaagtgaactaaattttttttctcttctcaaaggctatagataaataatacaatgtgcttaatatctgattgccattgaggtgattgatttgaactacaaaaatgagatgaaacccattaaattatgcaattttttattaatgacctttttgcaaagaaaatcatgtagagtttcaaaagcacataaaggtaacagcaatttttatcatccaattacctatggctaatagtattgtcctgatatattttggcaaatccattatcttttttgctggcctttctgctcagaataaagaacatatttcttcaatatccactctttttcttaaggattcaaatggaccttatatccacaggaaactcctctgactattgtataatttgatgaatgttgagaactctgtcaatgcagcagtgatttgtctctgtattctggacttgatttagctttattctttttctcataggcattctgaaatatttatgacaaagtgcattggtaatctgatgtaggagtcctgtgagaaacaaaaagaactaattactagcaaatttacaacsagtagcgcatcctttcaaattctgtgcaacttttaaaagaagcaaaataatggataaaatartaatataaatttaatacttttaaaaaattctataattgtttttttctcaattcttgcacatttcatcagttgatcattaacccgattgtgttagttcttaatacaaatgtagtgaacacctgcttttgttctagaggaattaatcaagcaatggtcaagrtaaatggagttggccttgatcgctcaggtgtttatgtacaagagttttccagcaagcgtattttagttgtaacattccagtgaataatcagaagtcagtytggggtaagtaccttagaaataaatagcttttgaataagtatgtatgcaataacattgcctatgaatgtttagtagagtatggaatggcatttcaatttactttggtgtaaaaatcatttgaatttatttaattaacatatcrcttttattctccttaaatgatttcaccacaaatcagaagatccagttcttataggactattcatcaggttgtttagttcagcattactttgtgctttctgataagatatgatccaaaacctgatgaggtaagtgagtttttaaaaccaatatttgtctgaggttataatttattaagtgcttagaaattttctagaaaaaatggatgtggatgctcaaataatataaatttaattattaagattattaataataatgagaaggaaactctaatactgagattctaccacaaagaaaaaaattacatttttaataatactgttcattattccaatataaaccaaatacataaagctatatctaatgtatttccagttgataacttaaaggtactaataacattttgactacgtatctacaaacacatattttggtcagaagtcttctgagaaattgaatatattagaagataatgatacacagacatttattttgcatgtaaaacttctcttactcactggtttttaactattgttgcactctcatttataagctcatatgctaaattaatccctaatgaaacatttgcttgatattaatagcatataggtctatatctaaagtttaccaacacattttctaacaattgctttggattgttttttgaggcttttgtcttttgcaaatatatatctaaacaaatacagtttaacaaaatacattgaaggataaataatgactccatagtttaatttggaacaatatttgactattagtaatctttatatataaatatagttgttcttagggactcctaccatttatggtacccttaatgatctgcaaaacactctagaaatgtaagtctctacttaaggctgacaacagactattctaaaggctttcatctttacccctaattaagggttacttcctagtaacttactgatggataagtttttaaggattactaacatgtattatttataaggtaaaattattgttactaaaatttatgaggccttggagtcaacattctaccaaatatgtggtaatattgcaaaactaattctgcttgagatataatcaaatggttgaatttcctgcaattttagtggagagcactttaatagggtattattagtcttgtgaattgtttatggtttttaattgctgctactcttacatttgttagtatttctgtcaattctttgatattatatttcattttatttatattttttcttttataatttcaagttttattacagattaatgtacatgtgcaggtttgctacatgggtatatggcctgacactaaggtttggggtataaatgatctcatcacccaggtagtgagcatagtactttattgtatcatttatatttgattgccattttgtttcaaactttgcaggttttctgcattgtatttgtcttcttttggaaaagcaggaagagggctttgggttattttgtcctaagaaataaagcgtgaggaaaattgtaaaaagttagccagattactcagttgctttagaatacattaattttctaatattataggtctaaaaccacactggagtaagtctgtttttattccatttcttcctcttgatctataaattactgtagagtagacagcacagaaggtttacctgatgtcagagttacagttatcccacttaaccatgagaaaagatagaaaaaaactattgtataactatttrgagataccattgccattgataacattccaacaytgtagtgtcttttttgatttttgctacaaaactacaagtatattttctactggttcttgaagatatgtaagaaataccattaacacatgaactatttttctgaatagatgatacttagaaatctaattggatagagttcacttgtggtagtaagttctattaagatagaaagctacaacaggtagaaagttttctgttgagctctctgtggaaaactctattttgaaaatgaatatattttgatttaaacaatacagagaagtcaaaatggacacaatcttcktgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggtgagactcttacatctccttacttatactggataagatatggacgcattcattttttaatattagaagttcaggataaagaaattttaataagtgaaaatgtaatgaaaagtacaaaattgtaataaaatggagaattgtaaatgtaattttcattcatttataattaattcctttaaaaggttacaaaaattattaagaaattgacatctatataaatgtaaaattaagtaaatatttgtacattttcttttagtttgttttagccagttttaattacttgagattatactgggcgtgcatgtgtgtgtgtgtatgtacatactcataaaatatacatctatacacatacatattcttccactatcactatgttgtgatcattttcccatgtcatggaactgattcaaaatatgatttttaattactgtatcttattgcctcttatagaagtaccattacttacttagcctttcttcagtaggttgtttccaacatttctcttaaaaaaaatgcacctcatctgtaacgagaccaagaaaaaacattaatttgttcattttaaaagcttatttgttactagttttaaaaggaaaatggaaaaaaaaggatttaaataatcagaggcctttgtgcttgtgaatgatgattgttttgttggagtctcctcatggactgtctgggatagtgtctatccctcttactgggatactgtgcttttgtgctggcatcccatttgaaagaattgttgcttggctggtgtggtggctcacacatgtaatctcagcactttgggaggctgaggcaggtggatcacttgaggtcaggagttcgagaccaggctggaaaaatacaaaaatttgcaaggcatggtggcatgtgcctatagtctcagctacttgagaggctaaggcaggagaagtgcttgaacccaagaggcagaggttgcagtgagctgagatcgtgccactgcactccagccagggcaaaagaacagactccttctccaaaaaaaaaaaaaaaaaaaaaaaaaaaaagttgttgctcatctcctcagctatctcatgctctcagtttctatagttgttttaattttcagcttttggattactctgagatactgtgttctaaatacagatttttgatttgggaatttagttgctacaactataatttcagtgtatttttcttatcacagagtagcagtatttagaaatttgctttcctgaaaatactatttacaagattttatttgcttcattttaaataaagacaattttatacagaaaagacgttggtaatagtgaagtgaagttaattgtaagaatttttctttgcaaatagtgcacactgaagccaatgtattccagatttagtcttgattaatttcagcaaatcccaatataccactcccagaaacgtttaaaccacatgctatagctttgaaaaagtaatacaatatttgtgaagatacataaattagagtctctgaaaacttaaattactttaaatggatacatgatatagagaaacacagaagttttaacaggtgtgaattgtgaacatgataaagtaatagtaataacgcactatcaaaaatatagaaaggatatcagccactgtttcatgtgcttaatatatattctctcatttaatatttataattactttgttaagtaaacaaccttgtaataaacctgagaaaactgaggcaaagaaaggttaaataatttgctcagtgctaattcctaaaataattcagtgaggattaagaatataagagcaatatattctcactaatatattaataagaatattaattctcatatattatgtaaggctctcagtgtcctcagttctccttctttacttcattgtcaaaacatctgctctgaatttacctcctccattttgctgaacatctgttaatactcccttttgctttacctctgataatgctgatgatgaatcaaaggctaaattcaatgtgcttcttttttccacagggttttgaaaagagaactgggcatgaattcctgtcccagttctgcaactaaatgaccttgtgatttggcacaagtcatgtcacttgtgaagcttcttaatctctctgggcctcagattcctcactgtaaaaagaaaagttgaggttaggtaatttatttggaccttttggctgaaataatctataattctacgactacgtttgttttcatctttggatctcccatatgcacacaaaattggcttttagacttttactagcagaagagaacatgcactgaattttagaacattttctggaggtctggtacaatcaaatcaagagccacattcacccatgacctgtgggttatccatggctctattttagaaaatgaaataaacttgttgtcattacttattaggagatatataatttttgatctgtgctaaaaatgtcattaatctagaaacgaaataaaatttatagggcagataatgttatattcttctccaaacttgtactacttagtgacatttttttcattgacttctgagttcaacagtttatcaaagggcagctgtttgtcacatagacttagaccttaagtacatgacataaatctatttgctttgacaaatgatttggaactactttttctccctttctctctttttttattcctttaaagatgttcatgtatttcagatttctgaaaattagtttcagattctgtcacttcatttctgaccttaattaattcttttggaaaagctctcgtgtctttactcagaaagccttttctgtagcctcccagctattgagatatttgtttcaggcttcagatagcaataaatggttacatctgaaatcattgtacaaataagtaaaatggcttaactttcttcccttccttatgtaaggaatttcagggttataaagaattactgaaattcttcagatctaatcatatggaagtaagttttttttatatctgaaattgtttatacctgtatctatataccagtgaacagagaatcctggagtttgaaatataatgcagtatacttcatagagcctcctgtgaggctgtgagaacgccaggccaaaaaggcaagtagggactgaaatgtagcctctgtaacccagctggacaagatgagaggccatggagctgcccagcccccagagagggaactatttttatttgcacaaagatgacctatgggctgctagctttctgatttaaaaaaaaaaatgtatttacacaagcttaggtacacacacacacacatcctccttatttccagtagaaatctagtagtaagtccctcttagtaatacccggttttcttgaataaagattaattgaatatatcaattttaggttatgaaagtggcatttgcagtatttaactgaaaatataatgaaggcccagaaagaacctatttgaaatagagttacaagacttaatgattgagttctaagattaagccagaaggaaatgaaaactgttggtacacttttgcaatgaacaggaagctattgaacctaatatcagggtagagttctctcatacgcatatatagcttccagacaacactacagtcagaacagtccaaaaataaataataggccgaaagtgattcttttagttgaccctgactgacttattttggctagtggttagagttaaaatggttaaagatttttattgttgatgtcgacagccaaagtatataaattcatgaacttgtagaaataggcaattctgattcttacgcatctctagagatgattacagaggttgccttgtaaaatttaaaacctgtacaggtgcagttgcttataagagaacaattttttcttcagctgaaataaaagtaatattgaaaaggattgctcatcactgtcatgcccccatcagcattcattagcattcccttttcataggtatcacatgctcacgttatgcaaataagattctaaacataaatttcaataactaaaaatgcgctaaatgtgactatcaagagggactttccttcagcttctataaatgcatattcttttttttgacaaatttcaaatttgcatggacattcttttttctatataaaagatgatttctctacaaaatgcatattctacaggagatacatccttaaaatatttatactaactttgaagggattgttagttatacctaagggtgcaaaaaacggtgatatgaatcagagtacttagatagcaaagctgaaaagctgttgtttttatgttgttcaatatgccaatatacattaaaattattttctaggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagrgatgataagtacctgggtagaaagaaaaacagatggtaaagtttcccattttcayaaaattattatttgccattgtattcatggtttttaatatcctaaagtaaagaatggctgaatattttcctactgcagtatggatcagaggaatcaaatatcctatttcatttcatagttatttaaattaatattaaattgtaaaactggaaagaaattataagctgctttgaaaagaatactgattcttttattttcttttgagagatacctgcttatagaatttttaatgaaataattttaataataatttttgttaaaacatagatttttcaggcataaaagcagaaataatctctttggccaggtagaagttaaatctgtcaatcccaaatgccttctttcccacagatgctgaaaatgattatcatattttagttgaatgtgttaatatttaataataaatgttaatatttctatcataaacatggtagtctacactttaaatgcaagctagcaaaaaatttcatagttgactacagagggatatagtaaattcaaattcatataaatctgagttgaaatcttagaaagttataagctatgctccatttaaaatgaggatattattaaaacatttcagaattctttggagttttaataataatgtatgtgaagtgacaagcatataccaagccctcaattaatagtactttgtttctttatttaatcagctatgaaaaatgtgatgttataagacatatgccttataggaagccttatatggggaagcataagttgaaagtgtgagataagcgtggtgagccatgttcacagctgtaggaaatgaggacatcactagacagctccatggcacccagtcatgcctatttctcataacttggaaaaactcactggacatagaaataggagaccagttatttggaggaaaaggatcatactagtatcctccattcttttccctttccaatggtcagtggacacagctgtcagaatggcaagtttgggtgtaccattaacttacttatgatgactgacattttagaagaccttgaaatagatggaataataccagtaaatatggaagaagtaatatttttattctttatgtctgacatacaatggttacaaatgatcttattggagagtctaggtatatctgagtttgcctaaaacagtctcatatttctaatttcgtagtgaaattccatttgcacctgtttcttcatgaaatatttaacagcaatcccgtctattctcaaaattaccatatttagatgataacatgccctatccaaaactgatctgcaaaagacacttttgctttaattctattcaaagcaattccactgaatcactattgcacatttcttcttacctcctcctccacccacttcctaggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggtaatgtgagaaaccacagttcctaagcatagtcttgagaattgccaagtatatttgatattttattttgtctattccaggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctaggtyggtgatgttattttattatacgagttcttacgtttccactcacataggaatttgagcagtcagctgaaaggtaacaaatacttgaaaagtmtattgacacaaatgaaaatacaaatgtatttggaaattttactctacttttggatactaaagcagggcttacctgtgctagcattgctttaccatgagaagaactgaatttaagtgcttagttttctctgtaaaagataagtatatgtcttaaaattagaatgttgggattagaaggaattattgtctttttattatgctaattttctccacttttttcctgactggaatttttaatatttatctcttattaagaaaaaaataattataatggtatgttttacacaattgaaagatatgttatatcactttgacggacagtgctctaacaatcattgaattataaacagaatcctatagtcaattttaggtagttagtacaaaatggaaattgaaagggttatctcaggaagcaataattatgaactaaatttttaacatcatgctcctaagggacagaagaaacttcaaaaagaaaggtgtgcccaaatgactcaattcacactctacccaaacttataaagagatttatgtgtaatagattatatactgtcgttttatttctaaatttcctttcaaactcatcaagccccaactgttttgtgctcccctgtttctggccattggtctcttaaacctcttggtttttacttccttttccactcagccaggatctagtcattagttatttcagtcatagtctcattaacatttttaatgtttttgtctcctttatccctttcctaattctcttctcaactatcctcaattctgagtccactcaacaagccactcctggccaggcatggtggctcatgactgtaatcccagcactttgggaggctgaggcgggcagatcatctgaggtcaggagttcgagtccagactggctaatgtggtgaaattctgtctttactaaaaacaccaaaattagctgggcatggtggcaggtgcctgtaatcccagctacttgggaggctgaggcaagagaatcagttgaacctkggaggtagaggtttgcagtgagctgagactgcgccactgcactccagcctggcaacagggtgagacccagtatccaaaaaaaaaaaaaaaaaaaaaagccactcctgttcttcaactactgcaactactgcaactgttgattttgttggagcaaaaacctggaaaggagtcacctctggctttaccgagactagagctcagcactccttccttactctagagaaccttctttactcctacccacaccataccaggacattacttctctccttcacttactactctaggttgatttctcttacttccaacaagtgtgccagtcttctatatcgtaaagaaaacctatcatcaggtaaactttctcctctctatttatagaaatcacctcaaaatttatgtaaatctttattaatcttctctttctttaccttctttgatattgtggagaaagaagtatcctctacttctctcatcctaactctgggatcttgatcaaagtattattaaccatccctttttttctggaaaagctttcttcctttagtccccaggacactactgacttatttctttctctctttctggaaatttttcctgctccttgacttacttctattttgtttctgttcccaagcaaaaatgtttatcagagtttcatcttcagaattttcctcctcttactctctctcagaaatatccctgttattctggtttttaaaatctgagtctctaaccccaacttctctttcatttcccagccatttgaatatctctacttgatattattctttttttcaaagaatattttttttagcacctactatgccaaacactggggtataatggtgtgtatgacagatggtttaccttctaataatgaaataatattttttgaaattaaattgtttattttcaaatttacttctcctagctttgaaatgatcactttcttggagacaaaaaaaaaaaattactgagtttgaaaactgtctgtgacatgtaccaccagtggggtctcaggagagtcacttgaccattttgagttgtrgttttatcaatataaaatgtggataatgatacttattgctagatttttcagtctaaataataatgcataagccccaacctcaattgacaggaagaaatacaggctttcaccagaatttcctttgacagcatttttaggaatccttagaggaatgtttcacagtccaaaaatctgtccaagctgtcacagtgtagacaactttgaactgtttggccttattctcagcatctccactctagggccacacttcccatacaactattcccacagtgtagacaactttgaacgtttggccttgttatcagcatctccactccagggccacactccacacttcccatactacccccacagtgtagacacagacttctctcttaattcttccaagcacaactgttatgggttgaattgcatccccccacccaaattcatatggtgaagttctaaccagtaactcagaatgttgccttatttggagacaagatttttacagagtaatgaaagttaggtcattaggccgggctctaatccaacatgactgttgtcatctaaaaaggaaaatttagacagagatatgcatggagggaagatgatgtgaagagacacagggaaaaaaatggccatctacaaatcaacaagagaggcatagaacaaatttttccctcacggccttctgaagaatccarcactgctgacatcttgatttaagacctctagcctctgcaactgtgagacaatctatttgttatttaagatacccagtttgtagtactttgttatggcagccctagcaaactaatacaagaacaacttcaatgtttaagcaaattttactgaaatcttggtgatagtgaaagggacttacaacatagcaagtaatttaaaaccaggtaccaattatgatagttccttgagtgtagactatttcttgtaccaaatagtctccttctgtccgttgttatacttagcctrccattgcaacagtgctagcacccaccttcacctaaaagagttatctttacacctccctcctattcagcattcagagtcctccaacatttcccagtataaagagaaggtgacccagattttcttccatgctctctaaggccagcttcccagttgtgacaagaatctatagttgccagatgtagtggcttatgcctgtaatcccagcactttggggggccaaggcaggaggatctcctgagcccaggagttcaagaccagcaggagcaacaaagaaagaccctgtctttagaaaataaaaaaaataaaaaaacattagttggacacggtggtgtgtgcctgtagtcccagctaccgtggaggataaggcaggaggatcacttgagcccatgtgttcaaggcttcagtgagctgtgatcctgccactgcactccagcctgggcagcaaagcgagaccctatctccaaaaaaaaaaaaagcatctatagcaggagacttcagtgaaaacaatgttttcatatcatataaaatagcttacgccctcgtcatctcaaacttccccatctccatcccactggttctacttgcaaaatgaaaaagcccattgtattgctttccctaaacaaaagaacaatttgccttaaaagctgaatttgaatcttcgtttttatagaaacaaaaacaatagttggcagttgtattccccatttccatacaaattccagccaccaatgatatttaaaaacttggcagtttcagttacagtatctcattacatacttctattcatagcacaaagtctggcaactaaaaggtgctaaataaatgacggctttattttatttttttttgttaaaaagatcactgcccagtcaataccaaactagaaacattgtcttctctgaattctcagactccactcctttctcttctgtgtggcaggcccttctctgtggtgtctgaccaataagttcccattaatcctccatggtttcccttgaagttattgcactcaaacatacctagttagagtgaaccaatccttatctatatttctagaacacttcaggaaaattcacatcatagcacttattacattgcacttttatttcttgctcacattcctgtctgtcctattaaaatgtgatttctgggacagcgggttaggtcttgctcattttagtttckgttgttcctagcatgcttcatggtatatagtatgtgctaaatgagtattattgaattaaattacacaaatattttcaaggaaagaaattctatattatttctctttatttaattttaaatatcttaaaaaccagaattcaactttccggtcactctaatttattctctttgaggaccctgatgaagctttcccacctttccatacatatagcatcatgaaaaataggacattagccatttacttcaaaacttctctctagagaaggaaaagtgagatttttttctttctaaattcagaggacagaaatttgttattgtttaatcacrctaatacagcattacatgtaaaatgcattcayttttttactaaattaatgtcttctgatttgttaaaggaacaatttgcttatgtatttagttcattaacaattttaacttatcagaacctgtttatgaattaagtttcctgagcaccaaaatcatggattaaaagttctgaaatacatttctcccaaaaggaacaatttcttcacaacagaaaaatacccgtttaaaatatgtgtttggtagagaagagagaaaacaacgtaggctcaataaatgtttggggtagactggcagatttatattttattactgaatgcggtggttcttttacatctgaataaatgtgaaatggttttcaaactgataactaagtattttgataaaattggaacagcttaatcaacttcattaatttcctagagctgctataacagcacaacacaacagagtaggtgacttagaacaacagaaattgattctctcacagtctggaggctaaatgtcaaaatcaaggtgtcagcacaacatgctctcactgagaccgttaggagaatccttccttgcctcttcctaccttccgatagtggctggaagtccttggtcttcctctccttatagataaatcactccaattatttcttctgttgtcatgtagccatctgtcttcgtgtggtgttctcatatcttataaggacaccgatcatattggattaaggcccattcctatttccaagtaaggtgacattaaaagatactgggggttagggcttcaacacatgaatttgggaaagggggtatgcacaattcaacccataacaccaactgtaataaattctatattgttgtaaaatatctctttggtagcaaagttagtatatgccaaaaaaaaaaaaaaccacccataagaatgtttatatttaagctacagtagaaaggagcatgtgagtgactatttagattatagttactgcttaagaaatacttctcctttccctcttttgtgtatawctagtttagaattgaggccaataagatatcatctcaaaatactcgagtgcttcccattatttattatctgtaatatactagatatataattttggacatcatcctgcagttgaatgttagctaaaataatcatattactttgtctaaatgtagtatgagatcctttaaatattttagtaataaaacttcctttggggccgggcgcggtggctcacgcctgtagtcccagcactttgggaggctgaggcgggcggatcacgaggtcaggagatcgagaccatcccggctaaaacggtgaaaccccgtctctactaaaaatacaaaaaattagccgggcatagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaacaaaaaaaaacttcctttggttgaagaatctaaaacataattgctatacgccgccagattcttctctgtagaagaatcattctgaaaatatagtataaaaactgtgtgtatgggcaaaaatgataatttaatacacataaggtaaataaacaagtaacttttaactttgtgaagtgttagcatttatattttaatagcaaatgttgtgattttatcatctgacttagttattctcccatttcacagataagaaaactgaggcactgagaagataaattgattgccattcaatgagtattgacagagaaggatyagctctcgtgtctattgggtcacagccttattagtttgatacttattagaaagtgtatttcctgttcaaaaacattgattgggattctactgtgggcaagaggctgggacagatgtaaagcaataggttccwtattgataagatggttaccacctattgataaaatggaatagtacaagatttgtgcaagaaattcactaagacagccgggagcggtggctcacgcctgtagacccggcactttaggaggccgaggtgggcagatcacgaggtcaggagatcgagaccatcctggctcacaccgttaaaccccgtctctactaaaaaaaaaaaaaaaaaatacaaacaattagccaggcgtggtggcaggcgcctgtagtcccagctactcgggaggctgaggcaggaaaatggcgtgaacctgggaggcggagcttgcagagagcccagatcatgccactgcactccagcctgggcgacagagtgagactccgtctcaaaaaaaaaaaaaaaaaaaaaaagaaagaaattcactaagactacacagcaatgtacagtaagtactaaaagaatcgtataatcagtaagcattagaaggttcacaaaaacggagagtgcacaggaaatgaattgtaaacaaaggcttcatgaaagaaggacttgagttgggttttaaaagagttgaagaataaatcctatatgcaatgaagaattgttgaatatgtccaagtaagacaatgaaatgattaagtcagtgttttagaaagatctatgtagtagtcagaattgttcaccctggataacttgtctgaaaaatttccctcttcctcatttatcccccacccctgccaacggttcctatttttctataaaacttctatttgtccttaaaattaagtttgggttttagaaagcctttctgatctctccatgcaatatcatacaagcatcttcccttctccccattgggaaagttctagtaccttgtgtttatttctgcatagcagttatattaaaatgaattgtttatcttcccctctgacccataagctacttgaggtgaagagctaggcatgtttcctctctgtgactgcagcaaaaagcatgtatataaaaaatagtagctattcaatgagsatttgttgctttaaactgagtagtggtaataacctggatttgttaaagagggaaagactaaagcctaaaagatcagttaaaaaaccactgcaacaactcggacattaagtaaagagtgtttaaagggagcagcctcactgggaatagtaaggaactggtgaaattattgaaatstgtgactaactagatatgggttaagaagaaataggttgtttgggggttccaggctcaacttactagaaaacaagagggctgtgaattcttgctgttttgtagtagtccttacctgggcaccatggacttctagagaggtctaggatatacttccaagggtccttgaagccctgaaattatttgcaagtttatgcatgtaaggttatgcatgtattttccttgggagaggctttatagttctcactgaatttttggaaatctcggcctttaaacttgttaagcactacagttctattcaaaagtatagtattatcttaataatagccatagtctttgtgagagatatcattctttaaaaatattgactgatgtggcacctcacagtaccttttgtcaattgttgaaaccagattactgaaaataatattgaagacccagagccctgccactttcttactatataactttaagcaaattacttttctaagatttttcttatactgttaaatgcagtaatgataacacatgcctcttagtgttgtgaggattccatgagataatgtgtatacaatttttagtgctcaatattagctaaatattatttgtattattactcatttaattctaacagtggccatatattataatgccaacattgtaataggtggccccccatcatatcgcattaaattcctcaatcaatttgatgaaggtctagttttacattaaggttacagacaagatggagacaggtaaataccttgcctatggtcacacagctaattaatggctgagccaatactagaagaggtcagccagacgtctgaaaacaggtgactgtagggcaagcaagagagggagcacagaacagaacaaacagtcagtgatagggtgagcagtaggatgagagatctggagtagccgtaccaaggagacttttcaaaagatgtaacacttaccacaggacataaatgatcatctttttgctggctagaaattaattctaggcttggccagccttggatctataagtgggtgaatgtaaattgtgtgtgggtggcaggaaggcaaggaaaatgagactggatatgagaatagatacgttgtgaccagctgcagtagtgattacaaaatgttcgtttactttgacctattggacatggataaaaatgggaatactaggcatacattaaacattatccagatgtttcatatgtgaaagtattttaaattcagcctgtgacgttaatagagtattttaattattttacacacacacacacacacacacacacacacacacacacacacacagaggtaattgattggaaagtgaccagaatttactgtgtactcacataaccatctagggccaccattgtcaaagattgtgttgtatttttctcctcatgagcaaccctaagatttggtttggttggttccagctctgaacagtacaagtgatatggtttggatttatgtccccacccaaatctcatgtcaaattgcaatccccagtgttggagatggggcctggtggaaagtgatgggatcatgggggcaaatttcccccttcagtgctgtgctcatcgtagagttctcacgagatttggttgttcaaaagcgtgtagcccctgccccctgtttctcttcctcctattccagccatgtaagatgtgcccattcctctttgccttcagccatgattgtaagtttcctgatacctccctggtaaccaacaaatgccagcatcatgctccctgtacagcctttggaactgtgaaccaattaaacttcttttctttataaattacccagtctcaggtatttcttttttcttttcttttcttttcttttcttttttttttttttgagactcgtatttctttatagcagtgtgagaatagcctaatacaccaagaatgattcaagcccactgtaccaaagctgggatttcagatgataacacaaacccagagggaaattgatccaagactttttttcattaaacaagaactctggggataaggggaaaggaagggccaataccattccccaacagggcctggaggccagaagtaggtcattcttaaaacaaaaattgggattgtttttcatttttctgcagcttttccctttgtgagatctgtttcagcacaatrgttacatttgggagtgaattactctcttttaaacaaatagatattatttgcatatgctaaaaattccattcatgatttagttgctaattgtttatctagcattttgctgctcattcttctacttttgcctgctgttcttttgacaattttagaggaggattaaggaaaagggaaaatgaaccacaactgggagaaatatgaagactcataaactttggaagagggacattatatatattgaccaatatggtggtgttgaattacattttgattagaaagtagtggcagttagcacattagctttgacttcaaatagacctgagtttaaatcatacctctggaacctaccttaaccttaagcctgaaaattaacctcctcaggcttctattttcttatacgttaatggaaataatgccgacttccttagatttttctaaagattaaaaactataatttatcttaagtacctaacacatggcagtgcttcttcacacctggctattcatggctccaataattatggataattaggaattggctgtagattatacattcattagatggctgaatgtgtttttattgctgtaggtttcattggactatattatgagcaggactgttacttaaatgactctccagtgataattaggcattattagaagttgtaataagtcttgcagtatttttgtcattatcctaaaattattggactattatagcccatttataggtagattagaacatatattctccaccctttaaaagcccatactccattcagtttaaagactgtggtaataaaaacaggaaaaaagccaacctcccaaaccatcatgctgcatattatctttcttagtaggaagttacaaggaagagggtgaaagcagttggcatagaatgagctattttctttatcagctgattttaatgtgcatgttgtgtccattcccaggtagataggkttctgaatgagttaccatcttccaaaaaaacatattgttttaccaagaaataatttagtcccagtagagttctgccacagcatgttcattgctttggagaattataattaagaagctcattcagtatttccaattaaaacaatgatctaattagactgattgccccacctaatttctagctccagatgtgggcctacctgctgaatgaacaaggatccttgagcactagcgtatgcattctaactggggagcacaggggtcaatgcccagagggcatagacaaagcccctcattgggaattgcctggaattttgctgatgtaggaaatatatatagctccctgtttaagattattacatgtgtcttttctttcataaacaaagtttctgatctgtatttaaaatgcaaattaatgctttaagcatctatgaagtcaataagtactagcttccccccacccccacttttatttaaatgggaaagtgaggttcagtgattgcttttgacttggaatcgtggaagatcagtggctgagaaaatcttttgggattatctggttaagttcccttttcacaggtgaggcaaattaaggcacagacaggtgagccagacactagtctcctaacttayggctcagtgttggaagcagtggctacctccttttttttttgcccaccccccccmactcctgtaatttttgtcttttatttcctttgaaagaaatctggttccccttcctttatccttttatagggcctatttaaaagatattaggcctgtccatacactaaagaacatctcattgactgtgacaatgggcgagatgaatgatgggttataaatatttctctcttccttaatagctaacaatcttctccaaggactgtggactcctgttccctgctcatcatgtcatgggcatctgccaggaaccatctttgatggtgtaaaaatcttgaatacataagagggaaattttagacttgttagaaagaagccaagcaattgagaccttagatagaacttagaattctcrccgagttttgttgggtaattgttacttcaaaaaaaratgcaatttctgttccctctttcctccaaccatttatctgggaagcaagttattggcaacccagagctgattgttggagccggggaaaatggtgtgaaatgtgagaaaatgtaattgagataataaaaacaaaagattttacaatatattatcctctaagtcatccattaaaaaattggtagcaaaaatgtgcagtgtttcaagacttttctttttcttttttttttaataacagatttaaagtagaacaaaaagtagacttcaaagacgttttgtattctttgaacataaccgagatatttagtggtggctgcgacctttctggaataacaggtagtatgataaataattcttatattatgatgttaatttgttttgttaggactacattaactagctgagcttaaaactgaaagagcattcagctctgataaatatacgcacagtgaataaatgtcatagtcatgttgagctgtctgtaaacaagcactttatgtttaagtagtttttcttaatgaaagtcaaaaagcattttagaatgttagataagcactctggctatacttctaataaaactacataagtaaaagtattatatgggtttttatttctgccctgtttggatctcctcatctgaataatgggaattacaactttgagtctctcatctaagcagagctaatacaactcttataaaccaatttgcaaatgttaattcactaatatgagaacacatgaaatagtcatccataagctgctggatgatgaacacaatcaagaaattgtaacgctacagcttgcagatttagcaacagagtcttttgggctgacaacatatctgagaagataagatggagctcttatgctaactcgcatcaggggaatcctgcatggttaacacgttcacttgtacaacaaagccaagatagtctttgaattcttcgagtctcagtggtacacactagttcaaaaataactcgctaaaaaaatggatgaagagagccagtttgtcccaagttacttaccctcttttaaattcagtcttctgttctataaaaatgggcctaagcttgtctgtctgatggggttgtaaatcataacatgaaatagtgcagaaatgttttatgtatttatttctatataggtatctgggctttggaaacgtgttgttaatttagtcatcacccatcaattatatgggcaaatgaacagaatgaaaaactttcctggtggaggaggtgaatgaggtcacaaatatcaaaatgttcattatcaccttcacacacggtgtagctactcgttctcacactgacagatagatctgacttctctgacaattttgtccgcactaggtatgagatggtcaacattaaatactgcaacaggatgctctgtaagtgtgccctgagacacaaccacctcttcaaccttcaataatccaaactatttttcatgcacttccttttcttaaacttctttctggccatagggagatcactcaatatgcctcagacacttcaaacagccacttgttctgcaaattcccagcaatttgtgacttctaaaaaatctcctgttacaggcagatttttaaagaaaatacttccaaaatgtttcataaaagactttattcaagaaaatgacccagtgcagaaaagaataaatgtccagcatcttctgttctttccctcttgagttacctatttgagctgttttaaccattttggttctgtcttattgcctagactagaatagtcatagccaatgctgatacccctgctggtagctaggagcacagtaaattctctgctatctctacttatcatttgtacaataaacattcactaaaggctactatgaagcagcccaacactagtcttatgggacatctgtgtgaaagggacactaccttatatttatatagttcacaagttttgaatgaaatgtttttatagagttattttggaaactgttagaaaaatatttgacttctcactcagttactactccttgtgtaacctgtagtaaaatatttaacctttctgagtgtaagcattctaatctgttaagtgagataatatagtgactggggaaataaataaaagaatgtatgtaaatcatctagtttaacatttggcacatagttaaatataaaacagcaagtgggaaaagtatcacattaatattacttgcacatctagcaaaygtattgttttcttgttctcttaatttaataacaatgtacttagaattttcatttaaaaattaagagaaataatgactatgaaggtataatgaatgagtttgtagagtccacattcttacttctaacctatcatatttcagggcctgttcttttcctaagactgggctttctctgcagtgagatggaacaaaggagactaagtggattagtctaatagccagggagtcatttgggctggtgccattgctaaactgggtgaaattcttcactccttcctaacctgctttttggtctttcctcttggtgtgggccactaggtcattccctctgtgtttatttgtcttcttccaggcagtcctgggagaagaaggtgcttatttgccggaccttgagagaaattctctcgcatttcagttaattcacactaatagtgtggatgcccatctctctccactttacaggtttctatcactagacatactcagatgcattgacctatttattattgacttatatattacaaatatttattgcgagccaattatgagccaggcagttttctagagcatgcttcctttgtcctctgaggaacattgtcagatctatcttgwcttgcaaggccagcttgacatggcttctgggctccgggtttcacttcttccttcttgaggagactatacttgcaattcactctaccagaaaygcttcacatatacatcagttccaccaaggggagaaaaaggagcattcactctcagctcatatccacaccagaacaaaacgttgtaaagcacgatcttatgctgaaaattttaacaggttttaaagtgtatctctgaagtgattttgtaacwggtgacacagaagttccttagaatttcatagcttccccagatttgaaggcaagtacattttattttaaactacgatcaaaaccaaatacagaatataaaaggcactttggctttgaggttaaatatacagggtgggattaattcagatctggaaagcctctttcattctgtctatagacaatggctaagggaggaaaagctctctgtcccttcaaatatttcacttagttggatacctgatttgaggcttacatcatttaccttttatatcacagaaaaacttgatctctctctgtatatatgtcatctctggaagagctaaacctataaatcacctttatctgttgcaaattgactaaataggaaaaagttcatttatttgtttccttgtctttgatcatttgaaaatctaatgatgctgggcgtggtggctcacacctgtaatcccagaactttgggaggccaaggcgggtggatcacctgaggtcaggagttcgggaccagcctggccaacatgccgaaaccccacctctactaaaaatacaaaaattagccaggtgtggtggcaggagcctataatcccaactacttgggaggctgaatggtagaatcgtttgaatctgggaggcagaggttgcagtgagctgagatcgtgccagtgtacttcagcctgggtgacagagcaagactccatctcaaaaaataaataaataaataaataaataaatgtaattaattgagatctaataggtaacggcttttgattttaactcttaaatacacttttgtgtatttttttttaaccagattcwtctgaagtgtatgtttcccaagtgacgcaaaaagttttctttgagataaatgaagatggtagtgaagctgcaacatcaactggtagggtgaatgatttctggccaagctagaaggaaacatggggagaggatgaacattatggtgctgacccttttgaagtattgtactcttctttttctcttctgctgtctaatacacttcaggaggaaaaaaaggaaatggttgtataygctgttcatatttctcttcagtcacagcatgatacaaaaaggaagggaaggggtttgattaggagttgagacctatctactgatatttgcttacttgcgaattggattacctgtgaattagcagataggacttgtggataaaactttagggctcaaatataaaatcattattttttaggaatgctcacccttacrtaattgtattttatttcattctttcaytacaccaagttagtcaccactttgctaatttgattcttgttattatctctgtggcagtggctctcaaacttaacctgcacataaaaatcacctgggaarctttaaaaactcctatgcccagtcaaccgggcgcggtggctcacgcctgtaatcccagcactttgggaggccgaggcgggtggatcacgaggtcaggagattgagaccatcctggataacacggtgaaaccccgtctctactaaaaatacaaaaaattagccgggcgtggtggcggatgcctgtagtcccagctactcgggaggctgaggcaggagaatggcgtgaacccaggaggcagagcttgtagtgagcctagrtcgcgcaactgcactccagcctgggcaacagagcgagactccatctcaaaacaaagcaaaacaaaacaaaacaaaactcctatgcccagtccacaccccaaaataattatatcagtatttctggaagtgaaatccagactccaaaattttcataggttttcctaagtgatatcaatgtgcatggaagaaccagtgctccatagtgctttgcagcttgccttttttattacaaatgtagtgcatagaccaacaacagcaccacttgggaactcgttagaaatgcaaaatctcagatccaaaccctagaccgactgaatcagaatctgtattttgcaagatcactaggaaatttgtatgtacattctagttagagaaccactcttctaggccatatttccttgaacaaatgacattttaaatagcatctgtgctgcatataaataatgcttgaaaaataattagaaaaaagccctaaaataattataaatggacaagcaactttaatgaattccttgtaagtctattttaattccccatactatttggattttaatcaatatttaaaagctatttatcatttcaatgtcttactgataaatatataaaaattgatattcatttattaatttcttgattaatttgcaatgctgcattgggccaatggattttgacatctggatgaaacacactggactcccttacaattttgtcatctcctgaaggatcttgcattgctgtgctcaaggaacttggattgtaggggatgaactatattaatctttgaagaagtcaaaaggttatatttggatgaaattgctggatcatgtagacaaattttccagctgctttcaaacagtactgagagagtccttatagattattgtttgatctcattatattggtgaagaaacaggcccagcaatgtaaagtggcttacctgaggccatattattgattgacagcagaatttgaacgcaactcatgttccctgactttaagttcagagctctttatgttattgcccactgtctctcattttaartctaaaattttctaggattctgtaacaatcattaagagaaggtagatgaatcaaagtaaaactcctcagaatagtcagyctgggtattttgactttcagaaatccactcacggactgctcaaaagcaaaaaaagtccaagtattcactgtaaatgggaatgggagtaaaactgatcttgcttttggatttatcgtagtaattcagacatgagcctatattcactggttatttaggtatacccttgatattctggataggagagtgccaatcatgttatcatactaagattatatttgactgttttataattctaatgatacatagtgattttatttttcctggggtctgaaaataacagtacaaartaattcaattattgggaaatacagtatctgaattaagcataaaacatttaatctagataggaaaaatatctaactttttatattttcctattctaaatattgacaaatactgtaatggagcaacataatataaataatcatagaaagtaatttttaaggcagcaaatttctgcttcaaatctcataataaaaatctcacacacattcactgcacaaatcctaaaagctctgagctcacagaataattttgaaagagtaagtaaaaaaaaaaattaatttgagctcagatgtgattaccacaaacccraagtgcaaatatacctaaataggaattaggaattacaaacattgtagaaataaatcatataatgcaaataaaaagtgaacagaaaattactgtttaaaagataaattttttcaactgctttcactaaattgaatctggtatctggcttgcttcttcattgagcatacatataaagttagaattattctgtgagtgacctaatatttattcttcagtactttggtttttaaatttattgcaaattccyctgtatttagaaaatggttatttttccacatgttaactccttacacaaaatgacttttcctrtctacaaaatgtattatgaatatactttctttwctgatcttttaatgcaagtatctaaataactgttgtctctattttataggcatacacatccctgtgatcatgagtctggctcaaagccaatttatagcaaatcatccatttctgtttattatgaagcataayccaacaggtaccttttttgagaattatttgggggaactgattatgttaagcagaactagttccagtttctaattgcaatgtacatatctgaagtcatttgttctttcagtggatatttgttaagtgcattttatataccaggaattgtattttaagagatgacmgaggcctaaaatagggcagtggtaataatggctgccatcatggctactatatgtggtagccatttcatataaccatcagtaaagctaaaaccactccagaagattagatatttgactagtaaagaacaaaagctcagagaaagattgtatggtttgtctcaggttacgtagctagaaagtgtcagagtgggaataaaggtcaactgtctgtgtatgatgccacattggggatggaaattgagaggtgtggagttgtgaaagaattcagaggtggataccaaaacagtaagtgactaatgtaggttctgagggataggaaggagtcaaaggtaatttcaaatcttcaacttgggcaactggtgaaagatgatgcagttaggtaaagggagtgtagaagtagtggattggattagcactgggcacagtgtcaacacagggaaattcagattgtctggatggatgcttcagcactttctcttgtgagtaagagaagccagaaatgtgaatacagtgggaaaattgtcaagtttatgtttaggatccttcagcagtcataatgctcatgtgagagttacataccacaggatagtagaaattatattttactcatctctgtattcaggccaatatttggcaaaatgccttgcacatagtatcagtttccctatagacagagggtgtgaaattgggttsggctcaatttccagctgaattcactaacagttgtgaaacaagttgcttgtcctttctaagccacattttccctatatcttatttgaacataatagtagtgctcatctcatagagttaaataaaagaatttttgaagcctgtaacactgtgcctggcacatactaagtgttcattatgaataaattaataaatatgaatgagggagtgaataaaagaagaaaggcaagtgaaaaagtttaaagtcatttacagggagaagagacatagttaattgcagaatctgaatctattagatgaactagcgatactgatattattggcccagtaagggatacttcactcttttttggctccatgaaactaatgctgagmgacccttctgaaagtcatatcttaaaaacaatgaaacagttttagaattgatgagattgcattaacacaacttcaattctagtaatggctgtgtcagtgttcaaatgtattctaagtatgtcatttgatctatgtgtctgtctaacctttagataattctaattttttacaattaatatataattatgtagtatggagacagaaagaaaaaaagctacattgggcatcaatgcacaagtaaataatggcatttagaataattatgttttactctattttccaggttgatgacttgttatatgcaaaggccaagtaacagctatcagtaaaacagcagcaaaagttcaaaacccaaaataacccacttatctgtttatttgtgataatgcttaactagcaggtcttaatgacagtttgaactgttttatgttctttattgtagtgagactttctaaactagggttactcctttaaagtattgtttaaaataaatggccgctcatttatcagggactgtcygttgttgccatataaaatgtagaaagggccgttatcttaagacaatacatatttagtgatttatcaatttttctctcacaaatgaactcaagaaatcattgagattaatgaagatagtgatttagcatcaccatagtgaactattaaatggcttcatggtatacataaagtgtattctgttgatgatttctgaagtatgaggatgaatgattttaggtttagtacaatcaatttttacatagcctggaaattttctttgatccaaacagtccttttgtgcaaaatctagccattatttggattttcctatcagatgaattttatattgcagtatattcctctaaagcccttactaagctaaacttctaggacaataaagcacctttttaaggttggggatgtaggccaactttataggctttgagaagaaaattgtgaaggatactcatgaaaggtaccattcctgaaaaaatagtgaattatgattttgaaattgacaggactccagacataatgaaagttattgtgtttagaactcttttgggttgtgtgttgaggggagaagcagattgcagaatatccattaagaattttttttctcgccattagcttggtaatgctattgtattgtaatattaggaggtaaaagttgcttccatctgatgaagatgttgtataaatatattgattaaatatgggggtacctatttaggaaggaagcatgaagataaaaaataatcatttttgcttcagtctgcctctaaattcttcactattatgtcaagggagattttattaatctgcccaatttagtagtragtagattgatgatggcatgaagattcaattcaaaatgtgattcttcctggagaaagagacagattgaaaaggctgggactaatgggttttatgtaacattctacccttctaggtatttaaaattttaagatattgtcctcaattataacttagtgtttatagaagttactttaaaatttttccagacaaactactctgatgagcattttaatgccatagcattatggcattaatattatgaagatataggagtcgctgcttattcctgttgtgactaaatgtaatatctattctaggagatgtatttatgtatctttatctatctgaaatattggggtatttgttttcttttttccagaattattttaatattttgaaacaaaacattgttgactataattattcataataaaaagtaaaatctgggccaggcgcggtggctcacgcctgtaatcccagcactttgggaggctgaggcgggaggatcacgaggtcaggagatcgagaccatcccagctaatacggtgaagccctgtctctactaaaaatacaaaaaattagccaggcgtggtggcgggcacctatagtcccagctactcgggaggctgaggcaggagaatggcgtgaacccgggaggcggagcttgcaatgagcggagatcccgccactgcactccagcctgggtgacagagcgagactccgtctcagaaaacaaaacaaaacaaaacaaaaaaataaaataaaatctgctggagtttatgtctatttycatgttatttgttcttcaaagagtgtgtctttggactgaatagtagagttaataaaaaagggccgtcccactattatttcaaatgcatttaaatatcattttattagctttaaaattatgcaaaatttgtcrcctttgaaattaacctttatgacatccgagcataaggaacttaaggcaacatttgacaytgaytgatttaggccacttctcttaacccagtttaaaagaaaggtgaatagattttggtacatcattctttctgttttgtcctttagttcttagttccttttcacttgcaaacacagaatggttgaaaacaggtatttgcatttatgctgtatactatatcactttggtcagtatttgaaaatactagagatataaaaatattgtcattggaggtaaagtaagctttgattcagagctgaaaaaggagaactgggaagttgcacttttagccctkaagacttacattacatgcataaaatgatgattgctaatgccttaaatttaaaactctaccaygctcatcaccgttttattatgctatgttctcyggactgggtctctatatttagaagaacacctctctgtcactttatttttgtttccctctatgaaaaacaggattaatgctttttccatgacaagctgtagtrggtgttaatttacctcataaattaccagaaaatgattaataatgatataattatgaatttgagacaaaggagaaggctttgctattagacactgcctatttatcttacagagaaaaaagaccaaatgacatgttaaatattaagaaaaactaattattgtcagttgttttctcctgaaattcctaaagtatatttttttgttttttttyccctagaatcaattctgtttatgggaagagtgacaaatcctgacacccaggagataaaaggaagagatttagattcactgtgaatgaaaagcacagcctcagaataraagatgatttctcaaaaatagctgattggcaaaatatcrtcrtcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccctaaaatactagactattagattcaggcatagtaccattttctagccatggggaaataagataaagagacaatggccatggtacatgcctctctggggtgtcactcaagacacagagatccagtattccttgcaatagaggagctttgggtatttcactaatcttaacttgttatttgacatgttacatttaatatttatgttgtttcagtaccttttgaaacataccagttttttttctactgatttatggttttaaaatgtacacaacatagaaatgctgagcgcttctgtaaagcattcctctttttataggtgaaagtggcagcataattagcgtgactcaggaagctgaacttccacaattttacaatactgagccaaggaagtgttagagtcaagattgtgcactataaagattaaatgcagatcccttcccttgaatactctgaaacatcacatctaaatatcaaaagctaaaactacattccaatattacttcatatagcatgtttcacagtttttccattttcaagctaatgatgtaaaattcctttttgtttgtttgtcttggcaattttggcagagagcttaatgataatggctgcacctcaatgagccctaattttgtgttgggctcactgaagtaagcactttttaccttatgttaaatgtactaaaatttttatgaaacagcattacctaacttcctgataaagaaactgagattcaaaaatgttataaaattagtcaaagacacataactgataaatatggtgggtagatttgaactcagaactactcgagactgacattcaaaaatgttataaaattagtcaaagatgcataactgataaatatggtgggtagatttgaactcagaactactggagagtgacattgaaaaatgttataaaattagtcaaagacacacaactgataaatatggtgggtagatttgaactcagaactactcaagctagaagtctgtgaccttaattactgagttatattccctttgcagggaaggaaaaagtaattttctctctacttctcatagctttgagctagtatcccttgtaataaaatacaggatagccaggtgtggtggctcacatctgtaatctcagcactttgagaggcttaggtgggaggatcgcttgaggccaggggttyaagaccagcctgggcaacatagtgatatccggtctacataaaaattaaaaataatagccaggtgtggtggygcatgcctgtggtcccagctactcgagaggataaggcatgaggatcacgtgagtccaggaggttgaggctgcagtaaactatgattatgctactgtactgtagtctggacaacagagtgagtcctcgtctcaaaaaacaaaagattcacaagagaaaaacagacatttgttaacatgtataccacatgtacacatagaagacacccaggaaaaaatgagtaaatctcaaagaagtggcttagaactctggcttacatagcatcttcgacaaagaacaatacatggttgaagaaatgacaaaggaaaaggaccttggatttataagggcagtaaattgtaggaaggcaaatatatggtagataaaggctattttgtaaaatttgttatgtagattcctgtggtgatatctccaggatgataagggtcttaagtcatcttcagtgatcaaattctgtcctacttggtagagagaggaggagggataactttgtgaatttgtattctgtttttaggcaaattgtttaggcaaggcaaataacttttcctgtatctacttcttctcagttgcctttagctcaaaataacccttatgctaaagtggcatcttttggggtggcatattctgctgccctccaccttctattttaattttcaaaatctaggtatccatctacagcaaaacctacagcaatactcaagacattatgaagccaactttagaatgaattgtgattgcttaaaaatcataacataattgaaagcaatgttcattactctactttcaatttgagcatacttagatataacacagtaaatactaatctatatgttagtaatatgcatttgtggcataaattcctcacaacatatctgttttaaaaatataagtctttgtttcaggaaggagagaataatgagttaagaggatagtagttttattcagctgtggtccagattcctgtttctcttgggttggctgaattcttctgatcctctttcatgcattaaatgtcatgctctggggattcattcattcattctacaaattttaattgagcttccactatgttccaggtagttttctaagcacaagggatgtattagtgagcaaatctgacaaggtccttgtcttcctggagctgacattttactggtagcagtaaaccagtgaacaaatacaaaaacaaggtaatttcaaatggtaataactgatgacattaataaagcagaagaagaaaataagaggggttcaataattgagatratgtaataagatcactacccaagtttcactttaagtacatattcttacagtgtgttcctaatgtatttgttttccttaataagatttgctaaaagtctgccacgagttcccgactgaggatcctgaaagcattatacagaagttgggtaatttatttttctgatttcatgttcttcttccatttggcttaaaaatgggagtgtcttccataagctcattgtgtggattcaagataaaaaccccattttctaccatgttctggaaatacatttgccgaactacttccaaaattaaaacatttaattttttccttcagttgtaagtaactcagtagttattacaagtttgcatcataaaggttacaagtatatggaatacatttacaaaacatacatctatttatgaaggaaaataagtatgaaataattttctttgctaaactgtatgaaatctgtaggattcacaacagtccataatcaatatgggataaaattactgtcaataccccttgtaaaagtccagtacatcatatataggaaatatttgtattcctcatggaggcaaaataattattaaaatagtagtatttcttttggaaactttgggttttattgacttcacatagctataattcatggcgtattctagaggagttgttaccagactgaacttgggtctgcctgcctggcacagcaaggccaaacaatgacattgggatttgcaagaagaaaaagtgaggcatttatcgcagggtggcaagcaaggaaaatcaggcagctcatgcttaagatctgaaatacccagtggcttaactgtaagagtttttaaaggcagggaggcagaggttacaggcaaagctataaatcagtacatggaggctatacgttggtttggcctaaaaaggtgggacatctcaaatcaggtgagtggggagggtggcatggcccacagatcacaggtggatgcaaatattttctgatttgtgattggtttggctttgtctaaaagtgtgggtcagctgaaaggagagttgagctctggcctgtgagcataatttccttcaggaccctcaggaagaaatttagaacaaagaatgacagaatttagtcctctgttccaccctatctgagatctatgtgccagcagatggcttttccatgtggtgaggggtccaggtctctgaaaaacaactcagggacatatgtgaagactttacctttaatttctatagagaagcaaactctgtggctctagcttccttggctattgttttcaggtattacagcattcttgcttatcaggttgctcatttacttctcagggctaggttggtgcctggaatttccctggaaggaactcaaaattttcctttatttccatgccttgggggtggcaggcccgtaggagggatccctgcttcatctcagagtctgccacatcacgcagtacaactgaaaagccaaagacctgagaaaaggaataatttctttctttggagaggcttataaaatctcctgaattgggtaatgatgacatggaaaccttcaaaggtacagagaaaactttaggcaggtttcattaaaagtctgtgccttggacctctggaaataagatacttcctcattttgtagccttataccattgaagcatactctatgaaggaccaaccccctgagccatggattggcctgagtctgattacaagcatatggtagaagtgtggacctacttaatttgtttgcttgcaagagcacttaattttgtgattccttcctccccttattgtcatggttcctcatatgataatctctaaatctgaagcctaaaattctaaatgtcaataatctagtttctttctccttttgattcctcaagtgaccaccctgatgatgtaaaggaattaaaagatgacatatttttcactgtccaacattataatttttggcttgtcacatcaattctctggagcttcaatgccctcacctataaaatgaaggattggttggactaatcctatttcaagtctttattccaaagttctatcttggcaaaccttgggcttctcctcaaagacacatctttgaaataatgtcttttgagtttttattgtctataagcagttattttacaaaaaacaaaagtacattctttcactcgtgtctgtgtgaagagaccactaaacaggatttgtgtgagcaataaagctgtttatttcacctgggtgcaggtgggctgagtccgaaaagagagtcagtgaaggtagataggggtgggsccgttttataggatttgggtaggtaaaggaaaagagggggttgttctctggcaggcaggagtaggggtcacaaggtgctcagtaggggagcttttgagccaggatgagccaggagaaggaatttcacaaggtaatgctatcagttaaggcagaaacaggccattttcatttcttttgtggtggaatgtcatcagttaaggcaggaaccggccatctgtatgtgkacgtgcaggtcacaggggatatgatggcttagcttggcctcagaggcctgacattcctgtcttcttatattaataagaaaaataaaatgaaatagtggtaaaaggttggggcggcaaaaattttgggggatggtatggagagataatgggcgatgtttctcagggctgctttgagtgggattaggggtggtgtgggaacctagagtgggagagattaagctgaaggaagattctgtggtaaggggtgacattgtgggactgttagaagaaacatttgtcatttagaattattggtgatggcctggatacggttttgtaagaattgaaaaactaaatggaataagagaaggagaaaaactggtattaaaggtctaagaattgggaggacccaggacatctaattagagagtgcctaaggagattcagcatagtcctgccagcaaaaattatttatttatttcaagagttaagagtggcggtttggggatagcagcaggagatatcagctgtgatggcttggagaaacagtgtaaactggcagtgtaaacaagagcagggcatttatgagtagttgagaatggtgaataggagtatgactagatggaagatagtagggatgacaagttttttggggcacagtctaagttggtctggtgtctggaatgagactggggcttaataaaaaggagcgtccatacaggagctcaaatgggctgtaccctgtagcattccaaggacaggcctgaattatgagaaaagaaagaggtaaaagtattgtccagtcctttttaaattggtggctgagcttggtgaggtgtgtttttaaaagaccattagtccgttct

SEQ ID NO: 17718 - DNA, 18825 bp, Homo sapiens
ttttctatagctgttattagaaattatctcaaaattagtggcctaaaataacacaaatttattatcttatatttctgtagttcagaagtctgacataagtctccctaagttaaaatcaatgtgtgcccagggctgggttccttcctggatgctctaggagagaatttgtttccttggcttaaccagtgatatgctttggctccgtgtccccacctaaatctcatcttgaattgtaatcctcacgtgtcaagggagggacctggtgggaggaggttggatcataagggtagttttatccatgctgttttcatgatagtgagggagttctcatgagatctgatggtttaaaagtggcagtttccgctgtactctccctcactcctgctgccatgtaagacgtgccttgtttcccctttgctttccgccaggattgtaagtttcctgaggcctcctcagccacgtggaactgagtcaattaaacctcttttctccataaattacccagtctcaggtagtatctttatagcagtgtgaaaacagacagatacatccagcttttagaggctgcctgaatttcttggtttgtggcccctttctccatcttcacagccagcaacatggcatctctctgatccctgttccttcatctcatctctccccttgattctctcttctgcttcccttttccacttttaaggacccttgtgattgtattgggtttaactgaataatctaggattatctccctatcttatttagcaaccttaattctatctgaaatgcatattacataacatgttcacaggttccggggattagaacatggacatctttgggggaccagtattctgcctaccaccaagattatgacaatctactcccaccagcagcatgagtgtttctgttggtccacattcttgccaacatttggttgtgacagacatcagtgtttgctaatctgatgggatgtatctaatatttttgctttaattttcatttcccaattacttgttatatattatatataacaaattatatatatacatatatatataattgtttctgagatggagtctcacactgttgtctgggctggagtgcagtggcgtgatcttggctcactgcaacctccgcttcatgggttcaagtgattctcctgcctcagcctcccaaatagctgggattacaggtgcctgccaacacacccagctaatttttttgtatttttagtagagatggagtttcactatgttggccaggctggtctcaaactcctgaccttgtgatctgcccgcctcagcctctcaaagtgctgggattacaggcgtgagccaccacacccagcccttttcatatatttataggtgatttcctcacttgtgatttggccattcacattctttgcctatatgctattaggatgttgccattttttcttattaatttttagaagttccttaattattctgagctactgaatgaatttttgatttattgatttaaaattatattcttaatatagtcaactgttttcatttttttacttcatggtttaggtttttttgttagaaatttttctgtattccagggtcataaaaatattctcctatattttctcttaaaggcattatggttttgctttcttgtagttgtcttcaatctgtctggaaatgactttggtacataggaggaagaagtttaattatatgtttttctttgtatacaaataattttttctattgagtagtcaattgttactcttctgatttgccacacctctttcatatattaggttttccatatgtgtttgggtctgtttctgggcatttatccatctcttcatcaagtctacattttcttaattacaataattttataataaatcattatatcccataggacctacttcctgacctcctacttcttcaagctcttcttggctactctatacaaattttagtatcagtctgtcaacatccttgaaaaaccagactgggacttctttttcatattgaacatattgactaatttggcataactgacatcttcgtaaaactgagtcttctcatttaaggagataatttatctttctgtctatgtagatctttttatgtttttaaataaggtgttataattagctttgtcttatgttaaattgttgcttaggtatcccatagctatttttgctactgtaaatgaaaactttatttgcaaaggcattttcaatttatctgctggtattaataaagcaatagatttttgtatgttgatcttatatccaacaaaagttgctcagttcttattaatatgtcttttgagtctcttagatttttctttatgtagatgatccactcatgataaataataacaacttcatttctttccatcctaatccttatgtttcttctccttatgtccttatgtcctactttatgggcagggacttccaatacacactttgatgaatagagtcactgtccacgggtatccttgtgttaatcctgcttttcaaaagtatgtttccaaggatttacaattacatatgtatctgtttctataggttttggtatttatgtttttttcagtttaagtaagttcctgtctgctttctagtttgattattttgagtgctgaattttatcaaacattcttctcatctattgatatgatgattcttctcctttaaactgttaatgtaataagttaacagctattctaacatttaatcaatcttgcagtcttggaataaactcaacttgcttatgatatatttttatgcacattgctgtgcataatgtgtatttttatgcatattgctgtgtttggctaatactttatttagagctgttgcatcaacattcttaatgagagagattgcagttttcctttcttgtattgtccttttctctttttggtatcatacttagtagacatgtaaaatgaatttagcacattcctgaacactctattctcagaagcagtttgtacaaaacggggattatgtgttccttgaatgtttggtagaacttgtccatcaaaccatctgggcagtactctatatacttcattatatcaagctttaagttatgtagtttaagtttctgtatcctttggcaggcttttttttcgcatttgaatgatcagttatgatatatgtgaacttatcagctttgttaaaatctccctccatgattatggatttgcccatttctccttataattctgtcaacctttggtttatattttttgaaactatattactagataattcagagatatcttcctgttaaagtatttctttgtatcataatttaactatcctcttttgcctaagtctattttttactgatattactactgctatgctagcttttttgaataatacttgcttggtgtgttctcttcctcccctccaatttaaagcttttaacttttaacatttctactttatgttttatgcatagcttttgtaagtgatgtatagctggatttttaaaatatttcttctctctctctctccttttctttttttcagggtctctttctgtcgcccaggctggaacgcagtggtgtgatcacagctcactgcagcctccacttcccaggctcaagtgatcctcctgcctcagcctcctgagtagctgagactacaggtgcatatcaccacaccagattaatttttaaattttttgtgcagatgagggtcttgctatgttgatcaggctggtctcaaactcctggcttcaagtgatcctcctactttggcctcccaaagtactgggattctgaacgtgagccccgactaaaatatttctatatgacaaatagaaatatttgtctcttaactggaaaatgtgtttcattaatatttatggtaattattggtatattttgatttaattttagcaaataatattgtacttttaacttatccttctctgtgcttttctttcctccttcattaatttttttttcatagatcaagtctttctttaaaaattccccctgcaccttctattcggatgcctatgtccatttggtagttgtccttaaacttataacaaatatttttgagcaaagcaaaattaattaatttctttttcgtcctcctgaacaatgaaatgattttagaatcctattactgaacataaaagcagcacattttagattatttccttatatctgtcttccagttcattaatattcttttcagctttgcctaatttgccacttaatccatgccttgagcttttaaaattttcaattaacttttttttttaattctagaagttttatttggttctttaaaaaaaatcacctagcctttttctttttgacaatgtcttattcttttctcatatttccaattccttcttttagagcttcagtagttttaaacatatttattttctagttttttggctgatatttcaactaaatgcagttcttggggagaggtgtctaatcctttttggtttctgctgattctcatttatagtggtttgcttcctcatatgttcaaatatcattgtgaattcttttttgttttcacagtggcagatagtatatatttgaattctaaacatatctgagggcaggcccaatttcacaaactcaaagggaccttgtagagttcaaagagagacatgattgcttcctacctctttgtgctagggcagagtgggattgtacctactgaaatacagtaggtaaccctgtgagggtcctggctttcatgaggatctcccttctaactctccacctttggcctaagctttgcttccacatggtcatcaacatttggtggttatagaactaataacccctatctcacttcactcctatgccagaggggccctagcatcagctcatgggattgttgtttttgctttcctctctatctttggctccgggattttccccttactttaatgggagctcatctgtaccttttaagtttttattaatatcatgtgaacacagacctgtatatattgttagaagcagaaatctctaagtttacttttaaaacatgatccttgcctcgaaaccttgtagaataatataatgtccacataataccaagttatgaaaagaaacatacctaaataactaaataagtatattccttttttcccccagctttttttccccattctaggtttacccagttgtactgtgttgtttgtcataggccgggtgaggtggctcacgtctgtaatcctagcaatttgggaggcgaaggcgggtggatcgcctgaggtcaggagttcgagaccagcctggctaacatggtgaaaccctgtctctactaaaaatacaaaaattaactgggtgtggtggcgggtgcctgtaattccagctacttgggaagctgaggtaggagaatcgcttgaacccaggatgcggaggttgcagtgagccgagatcacaccattgcactccagcctgggcaacaagagcgaaattcagtctcaaaaaaaaaaattatctataaaagtataggtgcaactcctcaagtattaaagacaagatagctcggattggacttgactttcagagccataactattcttaatatgttggtttatcttggaatcagaccattttcagtttcaacctgtaaaacagtgtacaaaggaaacatggaaagttttctatatataaagggttgtgaaataataacagctcacagaaaatgctgaaatgatgatttgcttcagtaccctctgaaatttctcccctaccacccctccttcatccccattgctatcaattcaaattacaacagctaattctcaggagaacagtagaagcccagtttctctcctctttcccctctgaccctcctccaattaatctgactgcagcgtaaacctttgcggtttaatattgtgcaacttccacatttccctcgctctcccacccagccccctcccccaccaaattcaggggaactcccgttaccgcagtgccaccagcattactcattcatccccattcaggctttcctcagcatttattaaggactctctgctccagcctctcactctcactctcctccgctcaaactcagctcacttgagagtctcctcccgccagctgtggaragaactttgcgtctctccagcaatgcatctccttgcgattctgttttgtgctctctggtctgcagtgytggccgagaactcggatgattatgatctcatgtatgtgaatttggacaacgaaatagacaatggactccakcccactgaggaccgtaagttcrctttaactgtttctctgctaaccctgactacatatccacctcttggtctaaataacacacatatactttgtggccagtgagacaagttaaaaatttatagcttgttatgcaaaagtgagaagcacttgaagaaagatggaggtttcaaagttatttctgtaacgtacataatgggttgaatcatatcaaatcgtcaatatttgactgttttgagctacataaccggcgatttcatagggtacaacttaatctatacctgaatgaatgatttctgtcgtttctgagacatttacatgctgtttttcggaggtgtccttaaagggaaggggaatgccaggaacgggctgcaacttggcaccaccgagggaggtcagcttttacaaagcacatccaaggcaggcctgggcgggctgctaacgtgtgtgtatcccgtactctagccacgccgtgcgmctgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggtaaggaggcaagcggggccgggacctcccactgcggctttgttccgggagcgcgcgtaacggcaagccaagccaggcaaccttctaggggaagctttcatgggaagcgcgcgcgcgcgcgcgcacacacacacacacacacacacacacacacacacccctatttctgcatgcgcggtcacagagctcaggcacaccatacaaggcgggaaaattggctttaaaaaagtattcctcagtcctaaggagccctaaagagagttgtggaggtaaccatcacagtcttgaaatagacgtctagggccccttacacccgatccgactargcgctgcaggagtccactggcccgttataaccgtgatccctcttgccgcccagcttccctccgttagggatttccacgtcttctaattttatcctgcctctgtctttagaggagctctggtttcccgcactatttcagggcccaggctaacgtttagggatgttttccagcccctcagccggcccctcctctccgcccacccattctcagcaagaaacttgaggctaaagctaatctcccgaagggtcagcggaattcttcaggggtcccccagcccccggggtttgtggaattagcgcgacaggggaggtcggagggtgtgcggtttgggattcagcgtggaacagtcaggtgtaggagccaatccgtgtaggggatcccagctccaccccagggattcagagaattggggccaagcaggagagagactgttcaaaccacaggcaacttctcaaagtcccatgtgacactccatgaatctccaaacagacatgggttcccaaaataatacattctaaagatggttaaaagaaagaaatagaagatttggagccaatcaatactcctttgtatgccaaaacttctaagaaatggtggtgtgacaatcattttggattgtattagaaaatcagtgtcctaggtaagaaaatataacttgcacttttcctgagaatccttccctgtatttccaagaaaacaacttttgctggatggggagggggaagaagcatgtttcatttaaagttaaagaattttatgtaatgagagcatgtttcatttaaagttacagaaaccatatcatatttcctaaatatttgaggggtgcttgtcagtaaatactaaatagggcttcagaggagaaaaagcataaaatcaaatgtacactagattctcaatgtgacaggagagaaattagaattctgcagccattttaatggatgaaatgtcttgtgtttcgcaaaccacgtaaagtcattgtacatataatgcacctgaaaaaccgaagaattactctattttttatcttcatctttgcatattagttagagcagaagagggatgcatttctgaattctaagatgttaatccttattacatccaataatacttttacccatatgctttgatttatcttctcttggtctccagccagcttggctcctaaccattctgttgttagcctcctaagaacctggttttaattttgtttggtctttgataatcagaaaaacctattagttaaaagccatttcataagagagtttctgacattttaaagaggtattaagagcctcgtttttgggtatccctggtccccaaaagaggatcaccaaaaatagccaacatgcggttccagtccatgaacttatatagccagcgtagcctagagggaagctgagtctctgagatgcaatccaggagtgctttggaatgcaatcctgactgcctgggcttatttaaagaggaaatcacttaattcgattgcagtaggcaccctcttgaacactacttttttgtttttttctttgagacggaatctcgctctgtcgcccaggctggagtgcagtggcgcgatctcggctcactgcaagctccgcctcccgggttcactccattctcctgcctcagcctcctgagtagctgggactacaggtgctcgccaccttacccagctaattttttgcatttttagtagagacggggtttcaccgtgttagccaggatggtctcgatctcctgaccttgtgatccacccgcctcagcctcccaaagtgctgggattacaggtgtgattgaacactactttattgaaactttatagagactatatcaaatgcccatggatatggtgatttttttcagtgatttttatttgattttaattaacacagctggaagaaaagatgtacctagcaatttcatttgaaaatagaatcactgcctcattaaaaattaattttaaaaaatcttcaaaagttcaaattatttagtgaaaaagtatcaaagcatgacagagccagttttgtgttttagtattgtagttacttttatatgattatctgaatgccaatattttatttgactatccctaacactaaaggataaggttcatatttgtttaatgttttcaggatagagcctacccctgagccacttgtaggaatctgacatagtttaccacacttttacatggatgtttggtttctgcaagttctttctctttaccagttattctggaaccattctgggagtttgcttttcaaagctgtcttatggcatatcttctttaggttgttatacctgccctaatttaggtgtttttaaaaaaatacctacatacacatacacacatatatatacacacacatttatatacatatatgtatgtatacatacatacatatccatatgtatatatgtgtgtatatatacgtatacatacatatatatatatttatgtatatagatgcagagctcacctgttctttcccagggacacgtaaaaggttttcgtttcagcatctccagcttcccaaatggctaagtcgccttgagatggacaatggtggaaacttactgagctttccacctcaaatttgaaagtccccctcccaagtgctctttagcagaaacatgttctccaaccaggccccttgaaagaatgtacttctcttaaagattttcaattactgcttaaatagtaattataagcatgtggacaaggtagaatttttaaacacatttttggtctattcagctcttaagtgctacatacttgctgcttacagacttgcagaatattaggagcagaatggaagggccttttttagataacgctaaagcctagaggaaattatggtgctcatccaaagttgcatggctcattagtagtaacaccatctggattctagccctcctagagaaatctaggggttctattaataagaggcactgtagtgtgctgattaagggcgtggcctctgtgaccagactgcaaaaattcaaactctagttttactgcttatcagctatgtaaacatagataagttacttttacctaagttttctcatctgtaaaataggaatgtaaaagactatctcttatggttggcataaggattaaaatgacaaacaaaatgattagaacagtatctgatacatagtgaatgcccaataagcttagtcatcattattatacattgttgcctttcaaaggtagttttctaaaaactctgcaaagtttacaaatatctgagaacatttggtgtattaaaatgtattctgcaggccaggtgtggtggctcatgcctgtaatcccagcattttgggaggctgaggcaggcggatcttgaggtcaggagttcaagaccaacctggccaacatggtgaaaccccgtgtctaaaaaaaaaatacaatagttagctgggcgcagtggtgtgcacctgtagtcccagctactccggaagctgaggcaggagaatcgcttgaacctgggaagcgaaggttgccgtgagtcgagatcgcactactgcaatccagcctgggtgacagagtgagactctgtctcaaaaaaaaaaaaaaatgtattctgcaataacatcactatcctagaattttgctgaaaaatgcatgttggtaaaggctaaatggagcgaactaggtytactgaatttcacaggtttattattttaggaacttggtggtggcaaaaagagagaaccaggttgggttctgaattcttggaaattatagaattattgtctgaagttaactgatagtgattcaacttttttaaaaaaaagcagtaacaaagaaaatatgcaaattggaaggggaggtagttatggcttttattattttgtgggtttggactagttggctcttctatttgcgtgctttctcttcatttagatgcttcattggataagacaattggctttcctttttctcattttctttgctctgcagagattacagtggaagcttcttaagtcgtaatgtagggtttcacatagctttcaattgtaatmattaaaattcttatgttaaataactaatgccagaataattctgaattaatttatattttctttaatattcttcttattttcttgctactctaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacwaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggyggctaccactgttgagatggccacaggtcacattgttcctgagggaggaatcctgcagattggccarraaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttyagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaagatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactagctcacgtcatttaattataaatttaagagatgttttggagcaaactcgtacttttctcttttcatttaaagtaggcaattagttttcagatactattatgtaaacagcatggttaatattgttaggaatgagcaactatagacttgttttaagtttggcttcctataaatcataagcaagaaatattatctctgccaagtcaattcatctctgtgggttttagttttctcagctgagaaatcaaggaattgatgaaataagaatctctaggactcttcccatttgacaattctaggagcttatacaactttctgtactgtgtaacataaaaacaaacaccaaacatgaattatcacagttcctcagatacacatgatgctgcaagacatggcttaggaatgttatttgggagacctaagaatctggaaaagaactcctgccctgaaagcacaccccattctcttccttactcagaagggagaggtcaagccccttcacactgtggatggggaggtaacttttccccaccacactagtattctcctgtagattctatgtgagggctgatagaagggcctcacaaagctgattctgaaatgttgtgggcccacagtgatgatatgtcctctgaaagatagggcatggacaaccacaggacatttcctcttcatgaggtttggagaataggaccaggagtaattttgtaactaactagctaggtgtcagacaagttacataactcctctgcttcttctcagtaaaaggaggtgattggactcagtgcctttcagcaataaaattccatgaatctaataatttttgagtatgttcatcatataagtatagcttcattccacttgtgaaacccacaaacgaggctaagcctctaagaaaatcacttgtagttaggggctgataggccagtctcagactcttggagatcacataattcaaggctctaggcacactgggcacatgcaaagtccctgtctagccattgtctatatgacttgaactcccagctggaagaaggaaaactagacccaaaacttaagcagaaaattaggcatgatttaaattcctttacatgctgcaacacgaattatacatgtttaagtgatgccagatgttgcaggccgagataaatgcaaactcatatgctgacagaatttaatataagaaaacttttaatttttttaagtaattacatgtttagggtgaagaacaaacaaatagaagaaaataaaataatacttgggttaaaaaagtagaaatttcatctgttagagcagtaagtctagctaggagttctagggacttctaattgttcccagatattcattttctctctttctctaaatgacagaatcctagctttagtggaacatgtgaccactcagagtaaattctatatttttcaacattacttgcagcttgatgcagccatataactatgttctgaccaacgctgaaatattatatgtgattcttttcctccttctgtctgattggaatatggtaatgggctggaatttcagcaaccatcttagaccaggagaccccatgcaacaatacagaagaagcatgggttcctggtcattgtgaagccatctagccagccctgagctgcctgcccacggacttcttttacgtgagagaaaaatatacttttgtcgtgtttaatcttttagttggttgatcactcaatctaattttgatccagtaatttttattttaatttaaaaaactacagccaggcggggtggctcaagcctgtaatcccagcactttgggagtctgagccaggcagatcagaagctcaggagatcgagaccatcctggccaacatggtgaaacccgtttctactaaaaatacaaaaaatgagccaggcatggtggtacgcacctgcagtcccagctactcgggaggctgaggcaggagaatctctcgaacctgggagatggaggttgcagtgagcccagatcatggcactgcactccagcctggcaacagagtgagactctgtctcaaaataagtaaatacataaattagctgggtgtagtggcgtgcgcctgtaatcccagctactcaggagggtgaggcaggagaatctcttgaacccgggaggcggagattgcagtgagccaagatcgcaccactgcactgcagcctggcaacagagcgagacttcatctcaaaaaagcaaaacaaaacaacaacaacagcaacaaaaacaactacgcactttattctccctaaaacacccataacctaaacttggaaaatgcattttacaaattctcaggaagttggatatctgacttaaaaaaacaacaacaactaagcaataacatttaatgactttgagaatatataggtgttagcaaaaggaggaaataagaaatgtgcaaaactgagataaaatatctaaagagaagtatcagcatgctggcttatgttagcacattgtcacacattttcatttaccaaatacttattgcgacatcaccatattacagcatagtaaagtaattgtgcaagatgactcaagctattaggaggaaagatgtatgtgtaataaatatgtaatatatatatatacatataaataatattatttgtgtgtgtagagtgaacaactgtcctggtttgcctaagactgtcccatctttagcactgaaagttccatgtcctgggaagccctcagtcccacgcaaactggaacagtttttcactctagtatgtatgtatatatctccagcagagctaattttttggcagagataatatatgaactaaacacagttgatattattttccttgtctattacaatataaattggcttataagtattaacacctttaaaatatattcagaacattctactaccaagcatatagtgtagaattgtagagctttctatttacaattacttgattgacttcactttaacaaagaattagatttgcaaacaaacaagaaattataattgatttttatttcatttcctgtcaaatcttagattagaaatctcttccctgagttttactaaggccaaatgtttccagcattgtctttcagccacttaagaaatgcactcctaaggttaaagtcttggttaaggtaattgtatatgttcattgatgtattcttggattcagtgaacatgaacactcctatcgttgatccttgcatcaagttttataaatctggagtgtagcagaaaagtttgctgggtttggggtcagaaatccagtattcaaatcctggcaccatcacctactaacttaataactctaagaaatcaggcctgtcaagtaatctctatgagtctcaaattagtcaggaacttagggataacaagacttgcctaccttgttgaaagattagtaagcagataattttcaaaaaagtgttttataaaccatgaagttatattgaaaataagatagttatcttaaaaaatgtttttccaagttgttttcagtggattgaaactaaataagcaagcaaacaaaaatacgaacaaataaatgaatgtaaggattcttttccattgtgggtaagtcattttcagagttcagcacacaaatgtccaaatctatgcaggccttgttctacttcacagcagcatctactggtgaagtcaagaaggtgcaaactctgagttagatcagatccaagatttggttaacaatttagaagtcttttcctgttttaagacgtctctattccttgatccatatgtgcattgtcttttcataactttacatttaatagttttctatgggtataaatattcaggttgaatattcttaataagattgcttagtagcttgtttcctagaatatttgattaataaattctttcccaacaacttgttttatggtgaacttaaaaaccacttcctttaagaataattgtatcatgaatttttaatggttaagcatttccctagagattatgaaactccatgagtggatatggttctgcttccaatcttttttttttttttttttgaaatggagtctcactctgtctcccaggctggagtggagtggcatgatctcggctcactgcaacctctgcctcccaggttcaagtgattcttctgcctcagcctcctgagtagctgggactacaggtgtgtgccaccacgcctggctaatttttgtatttttagtagagatggggttttaccatgttggccagcctggtcttgaactcctgacaacaagtgatctgcccatctcagcctcccaaagtgctggaattacaggcatgagccacagcgcctagcctgcctccagtcttttaatatggacctggtacacagcagatactcaattggtgatgacaaaaacaaccagaacgatgatgatgatgatgatgatgatgatagaaatcatggtaaccattgatgaactatgggcccagaattgtacaaaacatagatattttatctatttaagtctcatacatcctatatcacatatattataactgtcatattaaatgggggggggacaattttctatctccatttttctgagactgctcaccaagcaatggtttgaaatttgtctcacacagagaaaaaatgagctgaatttatcataattaactagacagtattttccaggtcattgccagcaagtaaaaaaggaatttggactcttgatgagatgttacattttcttcccaaagactttctacttaagtttccaatcatttgaagtcgttttgtgacttgtgccagaggagcatgtaaaaggcatattgatggtgaggcatatttctttattatgatcactgattcagaaatgcagaaaaagggacattactacttttagattaaatagcaatggtgttcattgcattatggagtttcacatcaaaattttaaaagggcttccctataaaccctcagataatccactgcagttgtagggtcttcaataatattttcagcttcttgagtgaaagatatgctaacttgtgctgcactaagcattggttgtgcttttatttatcagtactgaaaaggcattacagaccattttcatatggcaaagaacaagtttggagacttattcgggagcactggaaaacaactttcttttctaaaaaggttctgatgttacaaaacatcacattttacccctgatataatttaagcagaaaacaaattcattgcccaagtgatatggtttggctctgtgtccccacccaaatctcatcttgaattgtactcccataattcccacatgttgtgggagggacccagtgggagatacttgaatcatgagggtggtttcccccatactattctcatggtagtaaataagtctcatgagatgtgatggttttataaggggtttcagctttcactacctcctcatactctcttgccaccaccatgtaagaagtgcctttcaccttccaccatgattgtgaggcctccctagccacgtggaactgtgagtccaataaacatctttcttttggaaattgcccagtctcaggtacatctttatcagcagcatgaaaatggactaatacaccaagtgacatccttatcttattttttaattcaaggggaaacattaatatttccctaataagtataattttagtttagttgtttagtattaatagataccttttatcagaataaggatgttcccttttattgcttgtttgctgagagatttttaaaattttactaaagaagagacttagatttgttttatgtatttaggtcttattccatctgctattaatttatgcatgctgtgatgtggacaattgtctcaaaaccatttattgaatagtctgtccttctctattgtcaatattcccctagcatatacacagtttccatatatgcacagatttgtttcttgcttctctgttctattcatgggttatttacctatcttacactagtgctacactgtcttgattattatgattttataatatattgatatctggtacggaaattactgcctcttcctctcccccaacaac

SEQ ID NO: 17719 - DNA, 33829 bp, Homo sapiens
cttcgggagccttgtgcatttggatctatcctttaacaactaaccttgtctatcatcctcacagtctgactctttacttctgggatagtccaacagagacttgaggaaatgtttccttctctctttttccattttcccaaatttaaattcatgaaatatatataagttctctaaattaaaaacaacaggatattttaccaactttctgttctgagctaatttaaaatttatgtttccaatccccagagatatgaactaaaaagcctgaaataaatgtagatcagtcacttgagctgacatatgaagcagtcaactttactctgagacgttttgtttgatctttcaagtttctaaaagtatttggaagcgggaaacactgttcttcatatgagataaaaggaagaaaaaaggaccttatagtcaggctcattgtgaaaaaactaatattaagataagctgaagcaatcaaatgagagcatttgcaaatcacttgttggaggtaaagctggaagcctatgtagttcaggaaaatggaagatgagatggctgagatcccacgaaaagaccacgtccaatagaaactgtaataaaacagagctcagctacaggaattttcaatgatgacaaaattttaaagacatgcttctacttttgtattgactaaagatcttcaggttgaaagtgtcaagatctgcttaatagcatatcctctgttgcaacattcaaaatcatcaggattcttagatctcagtgaaaaattgatgtttgaagaataattgaagtattcagtccataaggaagcctgaagctccctatacaccttgaatttcatgctaaataatctgcaagttctggaaaatgctgcttaactctagaaaaactgactaaccttgatcttggtcagcatatacttggttctttacatatcacttatcaatggtcagaaagggaagaatacttgaacttatctaacacaaaaattcacaatttaaccaattgtttcccagacacgaggcttactagaagtgagccttgtaaacttttatttagctgcaatttaaataactttacattttcagatatgtgttgaagaccctaccagatgctttcttcccctttgagaagaagcaggaaaagaaaactttctctaaagggcaacttgactcttttcacacactgaagactttggaagctggtggcaacaacttcatttgctcctgtgaattcctctccttcactcaggagcagcaagcactggccaaagttcttatcggttggccagcaaactacctgtgtgactctccatcccacgtgtgtggccaacaggttcaggacgtctgccttttggtgtcggagtgccacagggtggcactggtgtctggcatgtgctgtgccctgttcctgcccatgggggttctgtgccactgtttccacagcccgtggtacatgaaaatgatgtgggcctggctctaggccaaaaggaagcacaggaaagcttgcagcagggacatctgctatgacgcatttgtttcttatagtgagcaggatgcctactgggtggagaaccttatggtccaggagctggagaacttcaatcccctcttcaagttgtgtcttcataagtgggacttcattcctggcaagtggatcattgacaatatcattgactccattgaaaagagacacaaaactgtctttgtgctttctgaaaactttgtgaagagtgagtggtgcaagaaggaactggacttctcccatttccgtctttttgatgagaacagtgatgctgccattctcattcttctggagcccattaagaagccatttgccttagtcaatctgggctgctatagcaaaaatgccaatagactgggtagtttatagataagagaaattcatttctcacagatctagaggctgggaagtccaagatcaaggtgttggcagatttggtatctggtgaggaactcttccaggctcaaagatagctgtcttctcactgtgttcttggtggtggaaggggtgagggaactctctgaagtttcttttggaagggaactaatcccattcatgaagcttctgcccccatgacctaatcactcatcaaagggcccacctccagtacctcacattgggggttaggatttcaacagatgaatttcaggaggacacaggccttcagtctatggctaggatcattccccagcatttctgttaagctgcagaagataattaacacctagacctgcctggagtggccactaatgaagctcagcgggaagggttttagttaaagaaaactcctagtttttagttcgaccattgtggaagacagtgtggtgattcctcaaggatctagaactagaaataccatttgacccagccatcccattactgggtatatacccaaaggattataaatcatgctactataaagacacatgcacacgtatgtttattgcggtactattcacaataacaaagacttggaaccaacccaaacgtccatcaatgatagactggattaagaaaatgtggcacatatacaccatggaatactatgcagccataaaaaaggatgagttcatgtcctttgtagggacatggatgaagctggaaaccatcattatgagcaaactatcacaaggacaaaaaaccaaacaccgcatgttctcactcataggtgggaattgaacaattcccacctggacacagggtggggaacatcacacaccagggcctaacgtggggtggggggctgggggaggggtagcattaggagaaatacctaatgtgaatgacgagttaatgggtgcagcacaccaacatggcacatgtatacatatgtaactaacctgcacgttgtgcacatgtaccctagaacttaaagtataataataataaataaaacatatcaaaaaaaagaaaaatgagcttgggagtcatcatgcctcctgctcccttcccctgcccccagcccccagccccacttctggctgggacctttgaagagtgcagttccctcttccccataattcattctgtccatctactcattccaacacactttttgatctgatttctatggctcagctccaaggtgcttgcctcagtcccctggcccgcaggagcccacaaaaaaaaaaaaaaaaaaaaactcctagtttttaaaagggaaatatatacaacatgaaatattctgttttcagaacttggttctatgttaacttagaagtttactactattattttgcataggcaatatttttgaaatgtcttaaaaaattacggacatacggacatctgtgcagagtaaaaaaattttgaagaatgtatgttcatgtataaagatctgtaaaataatgcaggatttatggcatattttcattaagtggttttcggtggatgagtttcttattatttcatctgacaattacaatatactttatgtgaaaaagacatagactgtgtgttttgttttgttttttcgaaacagagtctcactcttatctcycagcctcaacacactggactcaaacgatcctccaacctcagcctcctgagtagctggggttacagctacaaaccatcatgcctggctaatttttgaatttttgtagagatgggggtctccctgttttgcccaggctggtctcaaactcctggactcaagatcctcctgtcttgggctcccaaagtgccgggattacaggtgtgaaccaccacgctggccttgtgttttcggataactttcagataacagcttaggatttcagttagatgctcaaaactatgaatatatacaatgaaagttaccctttccccaaatattagtacatttcatatgccgtgttgattttctaactttaatcaacatttttttttttttggtagagagttataggaggtcttatatctagatacagaaggagacttggagtctaacctgggatttgccacatgttaactgtgagccatgcgactctgggcaagttccctaatcactttaaccaaaggaatagtaatatcagaattatttattgcatgtgttattgtaagattcagatgaaattctagatgtgaaggtgcttcaaaaatgtcaagaactaggccgggtgctgtggctcacacctgtaatcccagcactttgggaggcctaggctggtggatcacttggtgccaggagttcgagaccagcctggtcaacatagcaaaaccctgtctctaccaaaaatacaaaaattagccaggcgtggtggcacgcacctgtaatcccacctacttgggaggctgaggcagagaattgcttgaatctgggaggtggagactgcagtgagatgagattgcaccactgcactccagcctgggtgacaaaacgagactccatctcagaaaaaaaaaaaaaaaaaaagaaaatgtcaagaactgaacaagtataaggactgtgtctgaattggacgtgctaatagctttgtggacagtgtacaactaccttcaatatatgcagaggacactgatttgtggctaaataaatgatttctatctgactttgccagacaattctaattgactttgggattatagagcaatagcatcaaaatccaccttaggcagttcaactagggaagagaaatagagaaaaaacaagtttttagtttcaggagaaataatttgaaggaagttttcttttgtcagaaatcacaaggtagagagctggagatttggaattaataagaaagcattttcagccagctggacaacctgatggtcaggataaagaaaaatagtaagatagtgacctgtatacaaaaacctctcaatttcatatttaggtctattgattaagtttccctgatgttccaaccatcagagaggattagggatgtggaacagggtaggagaaacagccctggatttaaggtaaaattctggtttcaaatctcagttctgtcatatgttatacaattcacatgacattttcttgtgtaagggaggaacaaggatgcttgctctgcttcatatctcactttgtgaaaatcaaatgtaattatgaacataaaaggtagattattaacattaaggcagttgaattttaaaagcttgttttcttcccttatacatattcctaaccgtggagacagctaggttctgtggcaatgaagaaaattgatcaatgactgtttttggtattactttgggaagtagggatggaataggggcaagggaagggcttagcttcaaactgtagacagaagtgggaagcccaaatctttgcatggtgagaagtgggatggaatgtaggtgctagagatggtgcaccagtagggactgtcactggattggggaaaaaaatccggggctgtccttatctgctcccttaggcaaaatcgttctgtgttagtctggagggtgaacctattttaatgcaggagggcatagacttttgggtggaagcggaccctggagatgtactggcaggtgaatagagtgtggaaaagtggggaaaggagaagcacgattcatgagcctgagttcgggcttccatggatggagaagcatcaggagtggagtttaaagacggtgtgtttcaggtgatgtgaggtcctggatgcccgaagcttcaagaaaatactggttgggcacttagctttccctgtggttgccaatcccacgcaggccgcctctagcgtctcgattcgcttttctctgacctggaacctccgccaagcccccagctctcttcttcgacccagccttgcacggggcagctgtcggggcaggacccgcctctggcctgtcgcagcctagctcacggtcaagggcgggagcctgctgggaagcacggccgcgggggctcgctcggggccacctgcctggaactcagcgcgaggtccagagttccctccggctgcgcagcggcgcacgtgccccgtggaaggggcggttcccgcaccccagaaggagggggcgcccggccgcgcggactttcccttttgcttacttcctagtcccgggcaggccggctcggaggcagcgagaaagcgcagccaggcggctgctcggcgttctctcaggtgactgctcggagttctcccaggtacgtcgtgcgctccccactcgtgtggtctctctgcaccccttcctggggtcgggtcgggcaggggcggaggggagccgcagcccggtcacgggctctggggaacccgggctcccgttcggctgcacctgggcccctagctcctgtccgggcggggatagcgggaagcgcaccaggcccccgggacgccggtgcttctttgcacggcccagcgcgggaatgtggacaccagcgaagccggctcaggtcggccctcgggagaagcaggggctacacggaaagggagcccgagggtcctgcagagcccgaggtcgggaccccgcgcgtgcagtgccaatgggctgcggctgggctgagcgcccttccaaccttgcaggccccgggggggttgccgcggagagcttccgctggggctccgggcctctggccgccacctccctcgggaggccgaggggggcggtggccccggcccggccctcccgcttccctcacggcctggccctcccgcttccctgattcccggtagggtcgcyctccccgcctcctggcccctcttggctcggatgacaaagattgggtaaaggctttcaacgagctagcgtctggcagggggtgtgtcctcgctcactggttactgctaggacggagcttggattttggtcaccgtggctcagaggtgggaaaggttccgtgctctgggtctgtccaggaccctggctccctaacccaagtctgacctctgctccctggcaggcttcgccccacctctgcgttccttcattcttaggatgtgtgagttaggtctctgattagaaaacaacttacagcgtttaagcaaagtcgagtccttcaagtaagaatgctttgaagtgccctttacaacttcttcaacttctataaatatgaacttgtgtttagaacttaaatgcaagccaggaaagtctttttcctgtttgaaagagagagaaagagagagaaagaggtgattggaagtggtgggtgggggcggagaaagagaaggagagtaatctgggtgtagacaactcaaagtttgctgagatgactttaatcttttgactctgttattaagatttttaccaaagagcaactgtagctatggtggcctgacttgaagggacagaccaaacaaacaacaaaacacaaaacaaaacaaacaaacaacaaaagcaagagcamaaactattggaaaatgatttattcaccaatattttaaaggttcttcctgttctaagcaaggaacatctttaagttctttataatgtacccattttacatttacaaaaactgccagaagttgacagcatgttttgggggtttctaagctatcagttaattttttggggtacagttttattgataaactaacagagtagaaaaaatctaatggaatacccccaaatttaaaagagggcaagaaaagagagacaatagaacataaaacaaatgggacaagaataaagtacatagttgtcacagtcccttgggtgctgctgtaacaaaatacctgagactgggtaatttacaaagaacagaaatttatccattcatggttctggagtctgggaagtccaagattgaagggctgcatctggwgagggtcatctggctacattataacatgatggaaagcatcacatggtgagagagagcaagagaggacagaacttacttttataacaaactcattctcacaataaactgctcccttggtgataacattaatccatttatgagggtacagccttcataacctaatcacctcttaaaaggttccacctctcagctcgcagtgagccgagatcatgccactgcactccagcctgggtgacagagcgagactctgtctcaaaacaaacaaacaaacaaaaattccacctctcaacactgttgcattgaagatgaaatttccaatacatgagctttggggcacacattcaaaccatagcaatagttcaattactttaaagcccaaaatgtcagtaattatattaaatgcaatttaatacatcagtaactaaatgagatagactaaattttatgataatcagactaatattatcagactagacttcaaaacaacccaacaatcatatgctgtttacaagagacacatttatggatactaaaaggtataaagtgaacagatgcaaccatttatcaaaagaaagctgttgtggcaatattactattagacaaaatagaattaggaaaaaaatcataactgtagataaacgtttcactaagttaaaggtttcactgagaagaaataaaaattttgaatttataagtacttataacaacattaagaaactagaaaatagaaaaagaatagagccaaattgactgaactagaaaaatagaaaattcatagaaaaatccacaatcatagtgggagattttatcatacatctctcagtaactgatagaaaaaccagacaaaaatcaataaggataaagaaaatgcgaacacaatgtagttcacataaggaacctatactacttccaacagcagctgaaatcacagagcatacttaaaatctgaccatatactggctcatagagtaaattgcaatacattttaaagaatttaaatcatacagaatatgtcttctgaccataatgcaattaaagtagaaaagaacagaaaaacttatagaaaattctcatatatttggaaattagtaaatttctaaataacccatgggtcaaaaaataatcagaatgaaaatcagaaaatatttttaatgacttatgaaaaaaattacatataaaaacttgtcagatgcacctaaactrttgcttaaaggaaacttacaaccttaagtgcatatattagaaatgaagagtgacgaaaaatgaatgagcaagcaaataccttaaaaactggaaaaggaatagtaaaataaatccagagaaatcrgaacaggggaaataataatataagaatagaaattaatgtgctagaaaataggggatctatcaagtcagaagttgattttttgaaaatgctaataaaaatgatgaacctctggcaagacaataaaagctggtacaaataactcatctaaggaataaaattgaggacctctcttttgttaaatgacataagcaggaggccattatcctgagactgtctctacactttgagttcttacataataaactgcaacctaatttagtatactacataaacaaactgaaacctaacttaggagtctttttttttgtaattaatagctaaatttccaccaaatcataaatagccaagctttagccaatcacaggcagccaactgatcagactatgcccaaacaaggtaaatgcctattacaccatacccaaataaggcagactcctagctgaagccaatcaggtgattactatgctcttgtgtttggcctataaaagctcactgctcacactgttggatgctctctgaaacttttgtgaatctgagtgctgcctgattcatgaatcattctttgctaaaataaactctgtcaaatttaatttgtctgaagtttctcttttaacagtgtttggtgttgcaagcaggatccaaaggagacctatagtgactcccaggagctcttagtgaccaagtgaaggtacctgtggggctcattgtgcccattgctctttcactgctttcaactggtagttgtgggtaagttcctgctcagacttgagcactatacatttgcattttcagctctctgactttatttgagcaattctttgatggattggctccagaattggattggattcagtgaagaaactgaaactggactggtgctctaggaggcctcaagtagataaggttactagaagacagggaatcctgggcttatctggatttaaggagtctacaactccatctgcaactccagccgatttcatttataagaattatggaccaagaacctgtgcttttctagagaaatgtgtgagccttactaaaggtaacttagaattacaatggactgccgagaccagctcggtcgtggagaccctaacccagcagcgctagaggaatcaaagacacacacacagaaatgtagagtgtggagtgggaaatcaggggactcacagccttcagagctgagagcccctaacagagatttacccacatatttactgacagcaagccagtgataagcattatcgctatagattatagattaactaaaagtattccttacaggaaacaaagggatgggccgaaacaaagggataggctctggctagatgtctgcagcaggaacacgtccttaaggcacagattgctcatgctattgttgtggcttaggaacacgttaagcggttttctgccctgggtgggccaggtgttccttgccctcattccagtaaacccacaaccttcagcgtgggcgtcatggctgtcacaaacatgtcacagtgctgcagagattttgtttatggccaaatctggggctagtttatggccaggtttgggagcctgttcccacatgtcccccttttttgttttgcaaagcaataaaagcaaaggcagctttgtcacagtgagctacttcttgcaggagtcgggattcgcatatgcatactatacaaagacaaacaacacagattaaaagcacaaccatcattgaaatcacagagcttccaagtgtctttatctattttaatgggttaatcactgctaatctgtctgcagctccttcaagcactccagttcctggcattaaggtctggtgtgcctggaatgctttaaatatttgttcttttaatattgcaatatggaaagacaagtttgtagagtgtcttctaggtgcttttttattctttcctgaatttggtcttatttaagagccattaatagtttccacaaatccttatgtttagctcctacagcgggccatatcatttgagggtgaggtgccactataccatcatgtttccagataataggaactcttgccatatttcttgctatttctaccatctgaccattttgtttagaccagctaaacatagtgtggccatggcacgcagactgagaggtgcaatttaagctaaacatccccttaggggaccaatcaataatgattccataggaatcactgcgcagcacctctgcctattctgcaatgcaatcttcccaaacaagtatgttcattatttctggccaggtccaattctgtttacaaataggtttttgagggcaatatgcctcaattatagaaacagatttattatggtaaatactgagatcagaaagcatgtgtaactgtgtcatagaatgattacatccaggcattattgccagccaagattgataaatatgcccaataagtataattgttctctgtgttagcccttgttgaaggaatactaatggcaatggtgatcactgctatcatagctatcattaaattactcattgtgactggttgtcccactttcctcaggttttcttccaccctctatggcagtttcttgatctgtccccaggtagatggctgtgtttgatggttgttgctcgtgatagtttgggtcctcctcagcatcagtctcgacatggctgcaaccagagggtcctcgggatcctcccagaatctcttccttggcatctggctcatgataaggtttcaggtgtcttgatggtatccaaatcagctattgattctggcctggagaaacacaagcataacctctaccccaagttattattttacctatttcccaactttttgttgtcagatctctgcaccaagccagttgttctgcttctgtttttgcagctggtttctgtagatgctcttcagctgctgatagcatctggcctttaggcaggctcaaaaaatttaaagtcattaatgctagattcagttgtatatggggtgtcctgtaatccctgtttcccctttttgcttttgcaactgctgtttcagggagagattcattctttctacaatggtttgtccttgagaattatatgagatgccagtaatgtgtttaatattccatatagagaaaaatgtagctagagcttggctagtatagcctggggcattatctgttttaacagaagttggaattcctatcaccacaaaacactgcaaaaggtgatgcttaacacatgcagtctcctgattggcatgtagcccagacaaagtgagaaaaggtgtccacacatacatgtacataagctagtctcccaaacgagggaacgtgtgacatccatttgctaaagataattaggttccaatcctcgaggattaactcctcctgttaaagatgaggaatgcaccatttggcaagttgggcatcactggataatagctttagcttctttccaggtactgttatatctgcatttgagaccagaggcattaacatgggttaaattgtgaaagtgtctagcattagatattgcagtagcaactaggcgatcagccatttgattcccttcagttaaaggtcctggaagaggtgtatgagccctaatgtgagtgatgtaaaaagggtgcattctactcctaaatgctgtttgcaattgggtaaataaagtcatcagttgttcatctgtatgaagtcataactgagcattttcaattaattgtatggaatgaaccacataggaagaatcagaaatcacattaataggcatatcaaaagcagtcaatacctcaattacagctaaagctccactttttgagctgaagtatagggcgtgtgaaaaactttaccttttgatccagaataagaggctttaccattacaagacccatctgtaaaaacattctcagcaccttcagttggtttaaatttagttattttggggagaatccaattagttaatttcaaaaattgaaataatttcattttaggaaaatgattatcaagaatacccacaaagtcagctaaatgggtttgccaagtaagactatttatagaagcttgctgtatttgtgcctttgtgagagggacaataatttttccaggatcatatccatgtaatttaacaatccgaattctcccatttcttatcatcgtagccatttgatccaaataaggagttagagtctgtgaattagtatgtggaagaaaaagccactgtacaaagtcytgctcttatacaataacaccagtaagtgaatgctgagttggaaaaattagcaaatctagggtcttttttggatctattctatttatttgagrtttatggayttgctttttgattagctgcagctctgcctcagcttcttttgttaattgctgagggctartgagactaggatctcctctaaggatagaaaatagattactcagggcataggtgggaatgcctagagcaggtcatatccgattaatgtcccctagtaatttttgaaagtcatttaatgttttcaattgatccctacgtatagttactttctgtggcacaatggtagtgtcatttactaaggtccccaagtaggagtaaggagtagtagtctgaattttgtcaggagctatataattaaactggcatgagaaatcgagttttgcaagtgatcataacattggagtaatatttcttgagtgggggcagcacaaagtatattatccatataatgaataatgtaacactgtgaaaattttttacgagtaggttcaattgcttgcccttcataagtctggcaaatttttgaactgtttcacatgccttgtagcaacactttccaatacaaatgctttagtatgctgcaggttttttactgcaggaattgtaaatgcaaacagttcacagccttgctcagctaaggggatagtaaagaaacagtcttttaaatttatgactattaaaggccaattttttggaatcatagcagaagaaggcagtcccggctgcaatgtccccataggttgtataactgaattaatggctcttaagtcagttaacattctgcatttacctgattttttcttaattacaaaaactggagaattccaaggggaaaatgttgagctatgtgtcctttttctaattgttcagcaactaagtcctctaaagcctccagtttctctttactcagcagccattgtgctatccaaattggcttatctgttaaccattttaaaggtatataggttctggaggcttaacaatggccaccatcaaaaatgatatcctaaaccttggtgggaactttgtctttccgcttgaagcatttccttcaaagcttgcaaattttttcctagtcccataccagggacataccccatttcatgcatcatatgttgactttgagggctgtataattattctggaattagaacttgtgatccccattgttgtaataaatctcttccctataaatttataggtacagaagttataattttttgtatagtcccaggttgtccattgggcccttcacaatgcaaaatataactactttgatatactttaagggctttaccaactccaactatgttaaattgagcaggttgaattgaccatgcagatggccagtgctgtacagaaatgattgaaatgtccgctcctgtatctaccaaacttttaaatttctttccctgaatagttatttcaccagtaggatgtttatcagtaatttgattcacccaataagctgctttgccttgtttatttgtgcttccaaatcttcctgttcatttaatttcacttttccccatttccacatatggcataatcaggagctgtgctatatgctctcctggctctgctttccagggaacagaagtagatataacaatttgaatttcccctttgtaatctgaatcaatgactcctgtttgtacttgcacgccttttaaatttaaactagacctacctagaagtaatcctaccatccccgctggcatcatctgactggagacagcaaccttctttaacagtcccattacaaaaggagaacctgttccatatggattaatagcttgtttaaattctttgagtaatttaaaaggaaaaggctcaaatgtagctataatatttccctgttgatctacggggtatattctaacagggaactgctaagcctctatatcaycctctcttctaacttgctgaattcctggctgaatagaactgagagtggtcgctcgaggtgctgctcagtcactggggcgactactttttgcccagtgtcctctggaaaagaaagatctggaggatcaggctactcttttkcttcgaaataatgagggggtgcagaagggtagggacaaacctctccctcctttgccactttagctttagctggcaaacaaacctgctctgtcacctcttctgttacttcattatactttccttcctcctcatctttagtgtgaaaaggttccaaggtggaatgagctagagcccacacttgcccattgttaccctgatgcttccgagctccccttcttactcaccatggggattgcttaagagtactcgggtatcctccagctttgttccacgttttccaaccattgctccagcgagccttcatcctgggtttgagtccccacgttgggcgccacttgccgagaccagctcggtcgtggagaccctaacccagcagtgctagaggaattaaagacacacacacagaaacatagagtgtggagtgggaaatcaggggattcacagccttcagagctgagagccctgaacagagatttacccacgtatttattgacagcaagccgrtgataagcattatttctgtagattatagattaactaaaagtattccttacaggaaacaaagggatgggccaaaacaaagcgatgggctctggctagatatctgcagcaggaacacgtccttaaggcacagatcgctcatgctattgtttgtggcttaggaatgccttaagtggttttccatcttgggtggaccaggtgttccttgccctcattccagtaaacccacaaccttcagtgtgggcgtcatggccatcacaaacatgtcacagtgctgcagagattttgtttatggcaagatctggggccagtttatggccagatttgagggcctgttcccaacagtggacaaagaagaaaagctgcttaaggcaaacaggcacatattttttaaagctacaatagctagacaaactaagagaatcctgtgtatgttttacttttgtatttttatttttaatatttgtggatacatagtagatgtatatatttatggggcacttgagatattttgatacaggcatacaatggataataataacatcacggtaaaaggggtatccattacctcaagcatttatcctttctttgtgttataaacaatccaattaaaccttttatcataaaatgtacaataatgttgactgtggtcaccctgttttgctatcaaagaataaatcttattcattttatctaagtatatttgtgtacccattaaccatcccagtccccctgcwcctccaactacacttcccagcctctgttaaccatcattctactctcttatctccatgagttcaattgttttaatttgtagctcccacaaataagcgagaacatgggatgtttgtctttctgtgccttatttcacttaacataatatcctccagttccatccatgttgttatatgacagaatttcattctttcttatggctgaatagtaccccattgtatatatataccacattttctttatccattcatgtgtaggtggacacttggattgcttctagatcttggctactgtgaatagtgcagcactaaacatgggcgtgcagatatctccttgatatattgatttcctttattttgggtatatacctagcagtgggattgctggattgtgtggtagctctactgttagtcttttgaggaacctccaaattgttctccatagtggttgtactaatttacattcccaaccaacaacagtgtacagggttctgttttctccacatccttgcagcatttttattgcctgtcttttggataaaagccattttaactggggtgaaatgatatctcattgtagttttgattagcatttctctgatgatcattgatgttgagcacctttttatatatctgtttgccattcatgtgccttcttttgagaaatgtctatttagatcttttgcccatttaaaaaattggattattagatttttttcctattgagttatttgatctccttatatattctggttattaatcccctttcaaatggatagtttgtgaatattttctcccattctgtgtattgcctctgcactttgttgattatttaatttgctatgcagaaactttttaacttgatgtgatcccttttgctcatttttgctttggttgcctatgcttgtggggtatgacttaagaaatctttgcccagaccaatgtcatggagagttttcttaatgttttcttttaatagtttcatagtttgatgtcttagatttaagtctttaatctattttgtttttatttttgtatatggcaagatataggggtctagtttcttccgcatatggatatctacttttcccagtaccatttgttgaagagactgtcctttctgcaatgtatgttcttgacacttttattgaaaatgaattcactgtagatgtgtggatttgtttctgggttctctattctgttctgttgttctatgtgtctgtttttatgccagtaccattctgttttagttactatagctctgtagtataattttaagtcagataatgtgattcctccagttttgttctttttgctcagaatagctctggctattctgggtcttttgtggtttcatgtaaattttaggattatattttattaacatatttctgtgaagaatgtcattggtattttgataggaactgcattaaatctatagattgctttgggtagtaaggatattttaacaatattgatttttccaatccatgaacatggaatatctttccattttttggtgtcctctttaatttcttgcatcagtgtttatagtgtttctttcatcagtgtttatagttttcattgtagagatcttttactcctttgattaagtttattcctgggtattttatttgtagctgttgtagacgagattactatcttgatttctttttcagattgttcactgttggcatatacaaatgctactgatttttgtatgttgattttgtatactacaatttcactgaatttgcttattacagagagactaaagatagttaggtccattaccaaatgtgttttctgtcacattgaaaaattataccatgagaaggcacatgcttctagtaattacagttcatagatatgtcaatgtacagaatgctgttgtgacagttcacaattgtttgctttatagttttcactggaaattaaattactaagggtaaagtaatcccagcactgtgggaagctgaggcaggatgattgcttaatgccaggagtttgagaccagctggggcaatgtagcatgaccccatctacaaaaaaaaaaggaattctaattaatatgtggtactagaattaccagaaataataagggaaacaactctgaaaagaaggtaagatgtgttttgggtaagaacagctataaagtatgaggggatgttttgttttgttaaggaaaaaataaaataatatttgtcctaaagtagaatgcctggttgttaagacaatgagaaagagaaagagtatagaagaaaaactgaatggatataagaaagttgtagaaggttgtgggataggaatcctggaaagggaattttatatgtgatcaaactaagatttgaagaaaattctaagtttttttttaaaaaaattgagcatgaatatcaaaaacatactgacacagaactagaaatttgtcctctatgttaaaacaacaaggttttcttggagtattggtctgctcttaataagaaattgaaagacttttctttacctgctaagtaattggcctaggaaatgaagattctgtgttttattgagataatttattgtgcttcatgttgtctttattagatctttgactgcctcagagacctgagttcaccttattaaaagagaaagagtttctacaattatgtggctttctttatttgcctttgaagtcttttaccaatcactctagttaaatgaataaatattgtttcatagggacctgtgatcctattttaatcagatattttaaaccttttgatatttttgacttctcaaaatcaaattctaaattaaaaccttttgacgttgaacaaactttggaagcttctagatgggcttctggaatatctcaaaagaaattgttttctctcctgataaaaaagagagatattaaactaattrggcttatttgatatgttatattgcatgggaagaattgttaaattataagtgatgctgaactttctttaagtcatattgtatgggtatgttattaatatgtgcttcagaaattatatgaaattcttagaaaccagatagtcgtggtataatactatcagccaaaattctaattatcgtgaaatattatgtgttgcagaagtaatacaatttccttatcaattgcattattgtgaactctcatcatatctttaaccaagtccattttaagctttgtcatctacaaagagtcacttgttttactctggtactttccggaacactgtgaaaaacaattatataaagggtgtggacctataagacaaacaaccaaacaaaaatcgyaaagtgttcttttaaaagwttcgtggaaaggactctgataagtacaggtttctgataactttaagatcatactactggactgggtaagaatttccagaactctagcaaagaagtggattggttcataaaactgccaacccaacatgaagcagaataagaattaattgaataccagggaaatgctttggcagattttcatgctaagtcagccagtactgaaattgttaagatatgcaatttgaaagaacactataatattcatctgaatcaaattatctatgataacctatttaaatgaacagcatcatgcacctgaattggagaaacaaaactgatatttaaaatgatataaatttagtgttaaatgtggcctcatggatcagacagctatctggtcctttctgagtccatatagctgccattattaaaagttctgcactctatgactcatcacagaatagataacgtgaaattatgaaaaaatattggtgttatgactgttctaaaattgctaaaatggcttataatcaatgtttggtttgtcaaatccacaatttttataagataataaaaacctcagttggtacatttccaccatccactggactatttgaacatttacagatggattgcattcagttgcctcattgggaatctgcaggaaacttaagtaaatgctggatatgtcatgttgaaccaaatactaatatgcttttaaagatcttctaattcaccctatagcagatttcactgatattccaagtgtgactacctgttcaaattgcacatctggtctttctatagggttaggctttttgagtcacatattcagatttcatgtttaaagctaacagtagacaaaacatataggagaggctttacagttaaattattccagaaactgaataataaaaccaaaaggagagataattagacagtttgtagacgaattcataaccctaattctctaattgttggtagcctccattgatgataattaatagtggagccttagataaatactactattgcttccccgttgatgacccctgtagcacacagtgtcccacagggaactgtctcttgtgcccctctagcatatatttttatctatgaaggatttaactatcaatcataggcacaggcaactccatgtcccagtcagtaggaaataagaagtcagtgtggattagggattctaacagtaccactgtcactccataaccaactgaaaatttgacattgttctatacctcttaatttgcactatggtataaaaaggaactttctagcaggtacgaatccctctaaatgggcatcttttgttcaratgctccttccctggcttggaataaatgtaaatgaggttatgattagaaatccccttcaaacattagctactacagctcactctactgcaaaggctatatagttgcccagtgaagttctctaaattctcttgctaaagtttctttaaataacaggattgccttgaactatctgttggtttgtagtggggcagggggtgtgataggggacactgtgtataatagctaatacatcctactgcacttgcataaaggaatctgttataaagaaaatgaaataaaggtataaaagttggcaagaagaaaaccatcattatgtcttgaggatgattggggatacagaaaatgagaagaatccacaaactattagaattactaagttaatttagcaaggttgctcaatgcatggtcagtatacaaaatttaattgaatttctacatatatgtatatgccatattgtgttagattgttttgcattgctataagggaatacctgaagctgggtaatttataaagaaaagaggcttatttggctcatggttctgcaggctgtacaagcatggcactagcatctgtttgaccttaggaagcctttactcatggtggaagaagggggagcaggcatgtcatatagtgagagagggagtgagagggagggagcaagagtgaagggggaggtcccagactctttttaaataacctgaaatcctgtgaacagagtgaaaactaacttattaccatgaagagcacaccaagccattcatgaggggtataccttcatgacccaaacgctttccaccaggtcctaccttcaacactggggatcacatttcaacatgagatttggagaggacaaacatccaaatcatatcacatatataaatatgtaaaactattttaaatgtttttaaagtatcaaatagaaataaatctcacaaaatatgcttaagaactttaagcaaaaaccataaaatactattgtgataagttaaagaagacytaaataaatggagagatctgtcatgctcatggattggaagattcaatactgtaatgatatgaatagttcccaaattgttctatagattcaaaacattgccagttaaaatctcagtggactttgtttttttgaaactgacaagctgattctgccatttataataatattcaaaggggcaagaataaccaagacacatttgaagaagaacaaggaggaagaagaacgtatttgaagaagaataaggaactctattaagtgtatatctcctatatattgagatacacatttgaaatacatctatcacytagatattgagatatattatacatttaatatagtgtgttgctggtatagggatagaaaaatgaacattggatcagaatagcactgaaacaagatctacccctatatgggcatgtccctattaacaaaaaaatattgttgattatttccgcaagatgatctgtaaaaaacaagttaattgaacatccatatgggaaaaaagtgaatccttctgctacctcaaatatcaaccccaggtagattatagatctaaaagtgaaaggcaaagcaataaagattttagaaaataacaaagagaatatctttatgaaaatacaggaaatattttaaaaataggctagaaaactcactattaaaatatataaaatataagaacatctgttcatcaaaagtactatagtttgaatagcagtgtctcctccaaaattcatattgaaacttaatccccattgtaacagtactaatcctaaaactaagtattaagaggtgtgacctgtgggaagtgactaagtcatgaggggtctttcctcaggtatgggattagcatccttataaaaggccttgagatggaatgtagtgcccccttgccctcttgcgttctcccatgtgaggacacagcaacaaggcaccatcttggaaggagagagaagccctcaccagacaacagtgcacatgccttgatcttagacttcccagcctccagagctataataaatacatttctgttctttataaattacttggtctctggtattttgttayagaagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttatttaaaaaaaaaaagagggaatgcgaagcartggttttggtgcgaacacaaaaattctggcttcaacagcatttaaattcccaaaccaagcatgtttatgttttaattctttgtggccataaattgtacagctcaggcctttatagtctctcagattctgtgaatgtggggaattagttttactcataaaaagttttgttcttggggataaattttttaaaaaaatttttgtatagttagcacactgagaaaatacagacaaaggcatacagatgcaagaaatgaggtagctgaatagaccaaagaatgatatagggcccagaaggtaggcaaagagaaagttgttgggtttatggttacaagtaaactagcagttgtggtgcagatagttttatttcccccacattaatctgaacagcccatccagacttaaacactgctttttgcatttacttctaggcaggaagacagggttctgatggtgtgagtctccttcaactcagcaaaccaccttggtctgcctcgagtttccaacacccctcctgcctgctagtgataggtgtgaggcaggttgatgaacatggaacttttttcttttggtcccaaagcatgctactcctggagtttcattcagtgaatgagaactatagtttggttctgtgagatctctatgaatcaaggcggccactgaagcggagaaaagaaatgcttaaatgttaagaaagtttgaagtgcagaaaaaggtgattgtaaatccatatggttaagcttagcccatttcttaaaaggcttgattgctcattcctccattcattgatttactcactcttccaatccatgttattgagtcttgctctgtaattccggatggttgtgcttttaagtactgcatagtggttgtatgtctgtgttagcattgctgaatgtatcagggaattcatttttttatccccattcattcgttccattcatctgtttctctctctctctctctttgtgtgtgtgtgtgtgtgtgtgtgtgkgtgtgtgtgtgtgtgtgttatgcctagaaaacatttctcaagaattagaattacgatatgctgtcaaacacaatgacttatttgaacctcttttatttgtaggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaaygtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcaytctgaaaaacttgactaacattgatatcagtaagaatagttttcattctatgcctgaaacttgtcagtggccagaaaagatgaaatatttgaacttatccagcacacgaatacacagygtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattyctctccttcactcaggagcagcaagcactggccaaagtcttgattgattggccagcaaattacctgtgtgactctccatcccatgtgcrtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgatgagaacartgatgctgccattctcattcttctggagcccattgagaaaaaagccattccccagcgcttctgcaagctgcrgaagataatgaacaccaagacctacctggagtggcccatggacgakgctcagcgggaaggattttgggtaaatctgagagctgcrataaagtcctaggttcccatatttaagaccagtctttgtctagttgggatctttatgtcactagttatagttaagttcattcagacataattatataaaaactacgtggatgtaccgtcatttgaggacttgcttactaaaactacaaaacttcaaattttgtctggggtgctgttttataaacatatgccagatttaaaaattggtttttggtttttcttttttctatgagataaccatgatcataagtctattactgatatctgaatatagtcccttggtatccaagggaattggttgcaggatcctcgtggatatcaaaattcatagatgatcaagtcccttataagagtggcatagtatttgcatataacctgtgtacattctcctgtatactttaaatcatctctagattacttatgatacccaatacaatgtaaatactatgtaaatagttgtactgtctttttatttatattattattgttattttttattttcaaaatttttaaaacatacttttgatccacagttggttgacttcatggatgcagaacccatggatatagagggccaactgtaatctgtagcaactggcttagttcattaggaaacagcacaaatgaacttaagattctcaatgactgtgtcattctttcttcctgctaagagactcctctgtggccacaaaaggcattctctgtcctacctagctgtcacttctctgtgcagctgatctcaagagcaacaaggcaaagtatttggggcactccccaaaacttgttgctattcctagaaaaaagtgctgtgtatttcctattaaactttacaggatgagaaatactagagggtgtattttcatgtgatctggatctgtctttctggctattagataggtttctccagccatagttacttgagagagtgagtacacagtgcaaggtacagtaaattatgtatttctgtaatttaacaaaataaatactcagtttaggagaatttgaaagacacttcccacatccggactctggtcttcctcagcctctaactaccttttgagttctagttattgtccaatcactctgactctcagttcctgttttttagcctatatctcctgcatcttgttgctttttccttcttcgaaaagtcttgtttttaattctaaaaaagcctgccctttttccccttctgaatattttaaaaagtacatgtgagctaaatagatttttaagcaaatatatacctagagtttcctcataatgactcaaaaatagtttgatacacagtaatttaaaggtagatactactaccatatgttaattttgcaatctaggtataataataccacacattaaattttgatgcaactttctttggtaagcactatttgctgattctatgtaactttcttaagctgggaaccatgtgaaaggaagtgagcctttgacccctgctcaattctcaaccagaactgggtgtatgtggttaattgggcactagagtcagaaagacctgggttagtagatgtgtaatctttggcaagtcagttgacatgacccaaaaagtttttctgtctttaaaatagggatgatgatctctatatcctaagatactgagagtatgaaatgtaggaatgtaagtaaaccatgagcctaagctccttgattcccattttctctggaggggtgttgagggcaagagtaccacgcctaagagaatgggcactatgggttcgtgtgtggggtgagggtgatgtctgtagtagatgttagctattattattattttccaagaagatatttcattcccttatatattatggcttgtaagtggatatttttctgttatggatactagcagggatataagggatcctgctgtttgcagaaaaataccacaaagaaatatatgctcattaactgcagaacaagcttgtccttggggaactcgcatagggctgctgctgtttcacacgacctcccagaagagtgttatggaggaaacggtagccagccttaaaaaaaatcaggcttggtgtaatcccagcactttgggaggctaaggcaggaggattgcttgagtccaggagttggagaccagcctgggaaacatggcaaaaccctgtctctaccaaaaaatacaaaatattagcagggcatggtggcatgtgcctctggtcctagctactcgggatgctgaggtgggaggatcacctgagcccgggaggtccaggctgcagtgagctgtgattgcaccactgcactccagcctgggtgacagaggaagacactgtctcaaaaaaacaaaatgaaacaaaacaaacgaaaaacaagtttagaggaaggaaacttgagattccacagacaccaaatacagtaatggactttctgctttacttctctgtttccatgttaattatgagaacaaggtagatttaacattgactcgatctatgtttaatttcaagaacttaaaatagcaactgaaatagcttcatagataattgatagatttaaaataatatttaaaaaataatctttaggacggacgtggtggcttatgcctgtaatcccagcactttgggaggctgaggtgggaggatcacctgaggtgttgtggtgcctattcacattaaaggtggatcttcctttcctagtccactgactcaaatgttaatctcctctggcaacaccctcacatacacaccagaaactatactttaccagctatccaggcatctttcaatccaatcaagttgacacctagtattagccataatactctccaatcttttttcagtgtacatatacacactactttacaaaattgggattagattgtaaatacttaaattttataaagaaaatggcatcttcatttttttctgaggctgtttagtgattatctgacattcctgaactctgagggtcattgtgaatcccattcagataaatactggcttatttgccgagagttctaaatggttctgaaagctgccattgtggctatacataaaagataagtgggaactaaattagagatcagtttaagggttcttttttttgtttaacaggagaaaaactaattttttgttagtgctttatccaaatgtgaagtcttttatttgtcaatagactataagctcaagaatcttgttttatctccctaccccttgaacatgcctactatatagtaagtattgaattattgggatgttttcagagtagagaaataagcaattaaaaattctataatctggatgctgaatcaatcataatgagagaggagaaaatgaaaaatcagttcggtagacagctaaggctagtcttcagagaagcagtctgcctggaaaatcacagctacaggcaaaaatagagcagcctggggaaaactcagactgtacctgcacagataagcaggcaaggtccagcacagaagccttttgttctttgtgtgattagcaggctcccaggaaaatgttttctccccttttcagatatgaacacggggggatccatgggagattgcactggaaacagagggggtttacctaaaagaaacccacaattactcaaacaagaaaaaactatgctttgtgcttacctagagacatctcacagctgtataggtaggtggagttgtgcagacaggttttcaaataagagaagttactcaaacagctacagagatgagaggagtttcttataaaagcttttgcattcagctgtaaaatggcaccccacttgggctctcctctccactgtggagagctttcttctttcacttactaaacttttgctccaacctcaccctttgcattcatgctccttaattttctcagtcatgacacaataagttcaaataacaccttagacaatgagacaatggaccctgacctatttcaataatactgaagcattgggcagtttgaaagaggaaagttctcaacagtaagaaattgtagtgtgagttatcttaatgatggacctttgaatagcattaagtatagtgccaatatctgaacaaggaaaataatcattgtatttcctttctacttcatacaattgtaatggcttcaagtattgcagagtagatgtctggtgttaaatgtatacagtgttgactattttaaaaatgaccagtaattcaaaacaaattaattttgagagtccaacatatcattcatgggttaattctttctgactggtcttctctattcagttaattttgttcccttctgccagattaatttactctttcagcaaatattttttgagtgcctcttatgtgctaggcagtgctcaaagtgcaggggatatggtagggaacaaaacataaaattccttgtcttcatggaggagaagacaataaatttatgataggatttcgggtattgagaagtactatgaagaaaataaaagcagagtgccacaatggaatgactgtgcacgtgtatgtgtgcacgcgcacgcagagtggaacaaaagaaaagtgattcttcttgctttagtacagctgttgcatgggtttgagcacttttggcagctccaggaaacccaaagtacctgtggcccattgagaaggtgtggcacctgctgccagaggctttgggagtaacccactttctacagaagagctctgtggtgcagaagctgccacatggtaacaagcacatggagcagaagacaagcacaatgtccttgaccatagattacttaacgactccacctactttaaagatgttgaactgatgagaaagtattagctatggctaaatgttgtgtgtgagaagtactttgcaaacctctgaaacactttacagatattgttatcagtcaaaccggaagtagaatgtccacagtgcagtgtaacaaatgtgacatgtgcatgagttaagaaacagctgtaatgggaaagatgaaaaaacatgctttatttgtttattccattgttcagcttctctttaaattctttccacatggacaaattgcttgacaacaaagtttacttagttttctaaacacttgggatcatctctaaaattaaaaaaattaatattaaatgttggaccaaggatttcaaccatgcagtatgttgcttctggggtctgctgtcctattccagccctagtgaatagwtaatgccttgaactattccyatcaccacaggttgccaggccacsaaataacgaagccaatccaggatttgtccatacagaaaatgtgtgcgctcccagctaaatctcagttaaggaggttgttctatatacagccaagtagcagaaatattcataaatgtcatttgcaaatataataaacaatgtaatgaatgggtatttcctttcttgttaattctatgtgctcaattaaaagccccttatgtgagttttatagcattatggttgtcattgttacttacaccacacccaattcctgaaaataaattgaagttctttacaataaaatcccaaactagaaaacaagaatcaaaggcaagggtatatgctaaaagaaggaagaagaggggaatgactatattggaaaaccaaggatagtggaaactgctctaaatgagcaaaaacagctctgggctttcctgtagtcatacattagaatgaacccattgtatattacaaagaataacactggttcatcaggtaagagagacctttttctgctgtctttgataaactgtgctagggagcttaatgaatgcatagtgtctccgacaacaattttacaaacaaaatgacagctttttcacatgtagttttttcttatattgagtctcaataaaagagtagtatatgttttattcaacagtttattttctcaagactacataaagaaatgaatgaccctttgttaaagtatcacttgaggtgacatttatgatcatattatcaccaattttataacaaagatttatgcattgaggttttataggttaataaccaaaaactgttctggacttggtatcctcattttagaagaggaattccaggacagtggatgaacaggaaggtggaaggatcatcacacacttttagccttgagttgggcttgagtggcactgactcaccgagaaaggccaggtctgtggatggagtgggcactgcagagggtggtctcttgcaatggtatgggccttgagacccaaagatccactgatgttgcctccttctctgatgccctccttgaatccctccctgatctgcagtgcccagagatgagggcattgctgccagtagccattgttaaaccatacgtatagggttggtgaggaacaggggagcaggaagcaaggaaggtgattcctttagcattgtaaaatttagctattacttagaaagtacagaaaggctgtctcttagagaagagatggtacttggcaggttgatgccaacctttcaggactcttctgcttaagggaggatatgttttaattccattcccaccctgcttcctgaatgagatatactatggtcttgagatagtgaggttgaagacaaagtctttctagttagctcctgatgggggccattaccttcctgcgaccttaatgtgacttgaatttattctgttgcacatctctgatgtctatacaaatctcagtggctgccagaagctgatcaactctgtaaatctttatttattttcaatattgttatcactagtgtttggcctaagaagagatgatgcatggcatggaatttaaaaagccaaaatccagacggggaaatacctactcatttctgggaataataaaatttggtacaccctaacatattttaaaaatagttttctgtactctagttcacatttcggcttttaaaattt

SEQ ID NO: 17720 - DNA, 17303 bp, Homo sapiens
gcgacagagcaagactctgtctcaaaaaaaaaaaaaaaaaaaaaggagcagcagccaacttctcatcagaaagtaggcaaaccataagaaaattaacatctttaaagtactgaaaaaattaaaaaaaaaaaaacctgtcagcctcaaattctatacctagtgaaaatatatatatattttaatacagactctttcaaataaaagctgaaagaattaatcaccagcagagctgccattacaagaaatgtcaaagaagtttccttcaggcagaaggaaaatactagatgaaaaacaggctgggcacagcggctcacacctgtaatcccagcactttgggatgctgaggcagcaggattgcttaagcccaggagtgtgaggccagcctgaccgacatggtgagaccttgtctctacaaaaaaaaatacaaaaattaggatttacaaatacgacttcaggcccagcgcggtggctcatgcctgtgatcccagcactttgggaggccaaggcagatggatcacttgaggtcaggagttcaagaccagcctggccaacatggcaaaaccccatctctagcaaaaatacaaaaattagctgggtgtggtggcgcatgcctgtagtcccagctattcaggaggctgaggcaggagaattgcttgaacccaggaggtatgggttgcagtgagccaagatcacgccactgcactctaacctggacaacagagcaagactccatctcaaaaaaaaaaaaaaaaaaaaaaaaaaaacaaatatgacttcaacatattgcaaataccttcaacaactccgatatccctttgcaaatatccctttacaggctgaggtgggaggatcagttgagcccagaaggtggaggctgcagtgagttgagatcacgccattgcattcaaccacaggtgacacagtgagaccctgtctcaaataaaaaagaaaagaaaaatggatctgcactaaggaataaggagcaacacgatagtaaatacctgagttcataagactttttcttaatttctttaatctgtctaaaaactttggctatttaacatgcattgtggggctcataccttaagtaaaaataaaatgtgtgacaataatatcacaaagaatagaagtggggaaatgaaagcattctgtggtgcagttcttacactatctgtgaaaggatatcgtagttgttgaaggtattctgcaatatgttgaagtcatatttgtaaatcctagagcaaccactcaaagaatagaacagtacagtatagctaataagccgacggtgaagacaaaatgataccattcaaaaccctctaaaagtggttatgacaagagaaagaaaaggaagaacagatgggacaatggaaaaattggtgacttacaaatagtctggagattaacagtaatgtgctaacactggtgttttaattttgataaatgtactacggttatataagatattcacgagtggaaactgaattgggttattcagagagaaagatttcatcttccatatgtttatattttctgctggaagcaagcatttataatcaaaatttacctgggatacttggtaatttataatcaaaattacctgagatacttgaaacagattctaaagcccccacgccagagctactggatcagaatccaaggatggagtcttataaacgtgcataaaacttatgaagctttcctcatgaatccaacacaacccaacacaggtctgtatctggaaattgagacgagatggccctccaagccacgtcccaccctgaggtcgtcctatggctcttagcggtccatagactaaaaggctggatgatcagcaacgctgagacaacagtttcagtacagcagtggggatgagaggcaaggtcaagttttgaggggccaggacacagcaaagaagaggacacaaggaaaggggaaggaaatggagatggtaacacgaggggagggtgggatcggtgcacaacagacgttttcaggattaggaacctgggtgtattttaaggcagaaagcagaagccactggaggggaacagaagacacgagagaggcaaagtgttagagctttggccccaagatggccggaggctagggaagccccagtgagagaggcagagcttggcgaagaggagggatgagagagcatggctaaggtcagggaggatttaagagcgatggccgcctatctagaatgagccgcatgtggctgctgagcatttgaaacatggctagtccaaattgaaatgcactgtaagaacacacactggatttcaaagactacacatctgtaatcccagcactttgggaggcaaagtcaggcagatcacttaagccaggagttcaagaccagcctaggcaacatgtcaagactctgtctctacaaaaaatacaaaaattaactgggtgtggtggtgtgacctgtagtcccagctacttgggagcctgaggtgggaggatcatcttagtccagggaggtggaggctgcagtgagccatgatagtgccactgcactccagcctgggtgacagagcaagaacctgtctcaaaaaaatatatatgtatattcatttagacatatgctgttgcacacttagactatagtatggtatcagcatacgttttatatttactgggaaaccaacaaaattcgtgtgacttgcttcattgtggtctgggaccaaagctgtaatgcctccaaggtatgcctgtatatttctattgcaaaatgtgaatctcgaaattataaaagctacaactaggacaaaaagcaaccccaccaaatagccctatatcaaagaataaaatctctttctagaaccccagaatttgcctctttcagactgaagtttagccaaatctatgaaaaaagagcttgctaaaccaactaattatcagtacaaataaaattataatgaaaagtctatgaagataatttgttctcagatgcccttcacatatagcaattaattcacaaatgatgagtcactcatgtgccttcatgaaggcaggccctcaagagacccgcaacagaaaggaaagccaccgactggagagaacctgcttcctgagccccaccaagttccaaaaaggagaatggggcttcgtcctcaccctcaaggagttgccaaactgggcttggttattattcacacttgaaaagaatgaggaaggtcagccagtcccctccaggtcgctcgggcttcctccaagctcctcttggttcaaatttgctgtgtcctccagccggcatctctcctctgttccgtaactgacagggcagcgaggtagcttccggatgactcctcccgccatggttcttccgtccatcagctcttccttcctcaactctgtggtatgtggctaggggagtttccaactcccaggggacatttcagttccccaaagataacacagctttgcacagtggatgtttacttgctggtggtcttatctaagatcaacattggcagctgtgcccggagaggcctccagggtccaggtaagtggaggcttcatgtctcaggaggtacctggtcaccacagttaggatttttctgtttggggatttttttttttatgggttggtggctctgaaaaagctgcaagtcttctctgaggactacagacctctctccaccctctccacattcagcctctctgggctccagggccaaaagatgtctacactcaggtggcagacaggcctgtgaagacctcctggtgacatgctcatatgttgctgggactaaaggtgggattttagccaccacagtgggttggtggtgagatgtttaccaacaggaggtactttgtccctcatgtccacttaaagattcagtccaacccggcctgtgcttctgctgtcccaagagactctagaaagctccaatcctccctgaggttgatcttttaagtcagggtaggtggtcattcggcaatcaactgctctactgcctcaatgtcctcctcactggacgtcctgccccaattccatcctgttcagcgcagactgattttcctggaacacaatgttcattatggagccagatggcatatcagaaagagcactgtattaggagtcaagagatccatgggggaatcccagcattgcccctgatggctgtatagctttggggaaagtgaggccctcttggcattcagtttttcttccagcgaaataaaggattcagcctcccagagctttaaagtctttccaactctttcattcattctatggtctctctctcctcaagaatcctcagtggctgccctcctgcaaaaaaagcccaaacttcttgggctagcagttcccaaggcatccatcacctggccccaaaccaccttcttatgtttttgttatgaccccatcgccaccctcccccaagccacccagccttctccatgctgccctgatgtactctacccacgccttcacctcccctctgcttgccgcaaagccctccctccaaagccctgccccgagttcaccacaggcctctttcctggagcctttgctaacatccctgccgcaagccccagcctaaggtgagctcctctcctgaactgctagaacttctctgcagacaactcattggcccttaggggttcctgcctgggcacccagttggatgaagcactccagaaaggaagaaattcctggggccgagggaaatgaggcagtggccttggcctatgctgggaagtcctatgggcctggtatgaaaccattgtcatctgcagggtgtttcacaggttagaagccactttccccccatcgcctcatttcaccctcaaagactctgggtaaggggaattatttgtggtcggcgtaaggccagtcaatgagagaggagccaggcccgtgctaagcgtagatcttccacctccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttaraacaaacgccagtcatcctatataaggacctgacagccaccaggcaccacctccgccaggaactgcaggtaagctctctctactctccgtgtgcgtttgctgmcaggtttattgtccgtgactgctgcccgtccgtttaacctctctgggcctcaggagtcccctctaaacacgggggatgtcggactgtctggctggaagacagagcttcatttaggagctacctctaaccccctccctgctgagtgccctggggcccttgctggttcagcttcctccctcctcatgaaaagactcgccatgagctctcagagcctgggacaaaaggcaccggggaggacccccagcccctatcaagtcctgctgccaggtgttctgccctgaacggccttggagaagagaacacacatccatcatcttctaccttgggaggtggaagcgggggtcctctctacacagcagtcaggaccccagatggtaaagcccttcacgccatctgctgggctcctacctgagcaagctcagaggcacatgagaaggggaggcagctgcctggagaccctctctcccccaggcccacctgtctgcaacccagctgaggccatgccctccccagggaccgtctgcagcctcctgctcctcggcatgctctggctggacttggccatggcaggctccagcttcctgagccctgaacaccagagagtccaggtgagacctccccacaaagccccacatgttgttccagccctgccacttagcaaccagctctgtgacctggagcagcagcgccatctctgggcttcagtcttctcccagagcacaaaggactctgggtctgacctcactgtttctggaaggacatgggggctyagagtcctaaacagactgtttcccccttccagcagagaaaggagtcgaagaagccaccagccaagctgcagccccragctctagcaggctggctccgcccggaagatggaggtcaagcagaaggggcagaggatgaamtggaagtccgggtcggtacctctgcagttttatgcttctgtggcagcgaggagggtggggtcaggggagagggagggcagggagaggtggcagtgaacagggtcccaactacaagctccccagaactataaaaccagtaccacaggagttgagctctgccctgggctctgtgaggtctttacccattaagagaaaaatatctagaagaagtaactttgctacaacagaatagggacggaaggagcctgggcagaggagagagggtgccagagcctccaggcgactcaaaggggacagaaaatacagtgcccagagacaaagacacccagaaataaacggcaggcccagactgaagatgttgctctgcagaaaaccatgttttactcaggggcttccagggcctggactgtggggtggagtgcttccgaacagcaccctggatgggagggctggcgccagcccaggctccggcacccactcacctcgcctggaggcaaggagggggcaggtgtgggtgatgtgctctgacaaatcgtgcgtggggcaaggagaaagttaagacaacccaaggatggagaggaggagggagtaaaggattttacggggttttctatgcaaccttcctgtggctgtggttcagggaatggtttcttctaaatatttggttggtgacaccatttcgcagctaaggcaggattcccccaaggtagcacttaataatggcagctattagacgctgtgcccgaggataccaacttcacctctaactgccccacctcctccctacgacaacctgtgaggtaagcagggctggcattactcccactttagagccaaggaacagttcagaggtgaactcacttgcccaaggtaccacagcggtgtgtggaagrgacgcgacacaaggtcagggctgactccagtccccaagccctcttcctcctcactggtctgatggacagagacagcgcacagtggcccaggggaggcctcttccttccagaggagtgaaatgtgcccgccttggcctctgcctgcctgtttaccatactcttctccagtcgaggaataaagccgtcrgaagctcccccagcccctgctcgctttcatcctcaccagcacctggcggtgttcagacctttcctctacacggtgggatccactagattctcatctgaaagagctgcatacccttaggccaaaaccaggatattttgctggtgagacggctagctccacacatggtcatcccagccagaggagctgcccagtacccagatgagaaagaggtcttggtggctgacgacgcaaggtggggctggtacagcgggaactttgcagtttctgtgaaagctagccttggagcatgtgacccacactgccttggctggaaccagaagtcaaacgcctggggggtgttggggctgccagaagaggagtggctgcagagacctggagcgccccactaccaaacccctcacaaccgagtgtcccacccacctctctcatctcaggcccctctacctccccccaaacgtttccctcccaaaatcaagtttcagagtagaagactttggagaccaagtcccactcccattgaacagatgggccactgaggccaggagggaagctgccccccaccagccagcactgtgtcaccactcacttgcctgcaccacagcgccaggtgttaggccaggccagcagtttcccagaccggtgctcctgtttcctaagatgtctgccaggtgatcagccaccccgcatttgcctcagcggtggaagaaaaacaagtatttactggagggaatggaaggccccaactctccttaaaaaaaaaaaaaaaaaaaaaaaaaaattcaatcatgtcattccccactgggtccaccttcatggtggagttaaggggagggagatttcgaaaagggaacgcatagstattggttaatagcttctctgcgcctctgtcctcacctgtaaaatgggcacagtggtagcgcctaccccacagggaggcactgaggacgcctggcctcacacagaggaagggcaataggactaaagcagttttcagggccargtgggtttaaaagtcctgcattctagtccttggcctccaactccttgggcttctactgtgaggaccaaatgacccagcactaagatccttccctgactcagataagtcagtgcccaatatggccaggcaccgaggtagccactggcagagacaatctctgctctcaaggaaagtctgccatgtggctgcagcagagctccttcccacttacccaaagctttgagctccaataaatcatctcaggaatacctggaaaatggaagagatgaggcgctctccctgtagaggggaagaaatggaagcacagaaaggacttggctcagagcctctttctaggaaaacatcaacttccttttgattttccaggcatcaaagaaaggtctatgcatatgagagaaaaaatacctagggaaggagaaaaaggagaagaaacagacaagagagaaaggagaaagagctgggagcagggaaggaatagaaggccagcaggccagtgctgagaatgctgggcagaccccctgccagggcctgaaatgctgccattggtgactcaaccttttgtcttcaraactgcaagggagaaaaaaaatctcayactagggggcaccacagcttttatcagcaatcccattagaggctaaggctgagaggcatgagagtgcaaggtaagtgtctgaaagatggtgagtgggaaggtgagctgtggtcctgagaaaggaagagaacctggctgaggtgtcactcagcagtccctgctggggcccaaaggccattctccctctccactcctgaagagaggcagagagcccagagccccctttgagatggggatgggcatgacctctgacatctcctgggtcctccctgccctgcctcctagttcaacgccccctttgatgttggaatcaagctgtcaggggttcwgtaccagcagcacagccaggccctggggaagtttcttcaggacatcctctgggaagaggccaaaggtgagtcctgcctggactgggtttgctcggtttccttgcagccccacatgggagttcactctgtgggtgatgagttttccccaacctctgcctctccaaaagaacttctaatttccctttcccaaagatctgcaggakagtggttggctagtatttgtgagtggctcagaagggagttcatcatagtctttgtgttcaaagaatgttctaagaactagtacattaactagctttggggcctcagttgaacctcagcttccttaactgtaaaatggagctattttacctattgtgagagtctacaattatttggtgttacaccgtcttcactgcgtaactttactccacaaacaaaaaggaattggtgccaaaatagcactcagaacaggttctgcagcctgttaagcagttccttcaaatattagagcttcctgagttaagcaaagggtttgctttgaatcccctcaccttgtaaaagaaaaaaaagaaaccgcccaactgattgaggtggcagaaacacctgcacatctgcaaagcactgtcctcaccaaggcggtgacccgtcacccctggggaacagcaggggtagcattcaccccgctgtgcaaacgaggaaaccaagactcagagctttgaggtgacttgcccagggcacaacagtccacacttgagtgccgccctctgactccaaggccagtgcttccccacaacccccaccattacatcccacctccaatctcaccaccgtggaagaaaagcactagcaggacggtgcacccagcattcttactcaacctcttgctttccagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtatgctgatgttccaaatgggaatttatttcaaagaggaaaagttaatattttactttaaaaaaatcaaaataatacaaataaaaataattcttggtttatggtctgtgggaagggaataaaaggacaagtagcaaggccaatgtgcatgtttagaaaacctaatcacaccagctcactcaagcagagaagctactgcatgtgcatgcattgtgtggaattaagactgggtttcttagagaaggaggagagaaagggggagagtaggagggagaggggaaaaggaggagggagaggaagagaaagaagagataaagtgggactaagagaaagagggaagagaggaagaacaaagacacagttcctttaaacatcagggcttcctgagtgcaaggctgcattaacagcttattaacaaccagccagggctgtgtggacaaagaaacttcaggatgacattatcgaagccaacatccattcaagattggagaggaagacaggaatgcccaagagtgaatctgaagttagacgttaagtgaggtgcccaatcacggctcttgggcactgctagacagcactgaaagagctgcattctccttcctcccttctccactactgagaaggcctgacaaagcaaatgcctcacatgggcaaggctggccgtcgccrtggttcccttactgataccaggtgggatccccaaacattccctcaactccagttcacagcagacacgagccttgactcttatgttccacaacttaattccagttacgacactggtcttcccgggggaaggccactcggtcatgcccaccttagcctaaacatgtggactgacttgactgtaggcaacggatgggacacatcgctaaggggagggaaaggcaaagaacgaggtggccccaaagagcagcaccacagacttgccaattcagccatctgagcgcttgtgggaaacatgcaggaagccgtctgcagagacagttggggtaatgcccacactctggaaaacccctaccacagagggtgctaggagccgagcgtctccccaagtaaaattctggccgccacacatgcaggcactaactactgatcaggtgcggcaggcagacagaaacccaactgctctccctcacatagaagctgtggtctgtgaatgccaccgtcatccagggactcttagaaatgtagaatcttgggcagcaccccagccctaatctatcaggatctgcattttaacaagatccccaggctacttagtaaacggctgatgggaaatggcttagaatccccttcccaggcgtcacagcacactgcaggccccctactcacccctccaccctcagacagccatgcccctacctccccaggcacctggcacaagtgggtacagagatcaacacacttgtcctggaacttaactgtctcagctctgtcacttagttgggatacgaccttgattatcactaactgcccacagccctcttatcaatagctacagaagaggagcaaaggcccaatatggccaaagtggtcaggagatggtttctttttgagaaagcaccactgattgggcttgggagaggatgggtaccaggctctggacaaatgctggtcacctgatgcttcccccaccaaagacaagaacttacttctctctcaaagaaatcacaagcattattaaccgcctgcctgggtcattcaaatagaaacagatattgcgcacccactatgggctgggcactctcacctgtgccaggcaacaaggtgtagtgcaaagatctgggctttggcctcggacctgaatttggataccagctctgtgatccaggccaagactgaatttctcaggctcctcacatgtaaaatgcctaccttgctgggttactgccaagactgaacatgaggtctcacatgagctgtagctggcaaagggcccggcacgtagctaagcattcaattactacagcagccagcactcactgtcacacccctgatgtacaccaggcaccgtgttaaatgctcatgcagattaatgtgatttcacttcattttcacagcaagcctacttatgagggagaaaactaaagctcagagaaattaagtaactttcctaaagcacacagcaagcacgtggccgactcacagccaacgccacaggactcaggggctgctttttcatccggttccacagcctctcagccagtgcagcttccctcgctctactgcctaggatgagagaggtttccatattcattcattttccttcagaatacactgggtgaacttggtagaggggtgaggacaatttcaagtcaacaatgggcagaaatataatttatcaaagaaaatggttggaggacacccttgagaaaatgtattatttcaaacatgttcctgtatcagctttcttaaacccactcctttatggatcgtttaatgataccactgtaacttgagggtctctaaagtggggtgtatgtacccctagggtgagcgagctatttgctggagaaaaaaattctccttgtgaaaaaacttttactttgtgtataattagcataagagcacacgtatttaagttctcatgcacttatagttgtgtgttcagaaatcatcttgagagagtgcacagaaaagggttgagacgcctcaactaagctacccaccttaatctgaatccacctacaaatgtcactggcatttggggggccgaggcaggtggatcacctgagatgaggagtataaggccaaacaggccaacatggcaaaatctcatctctacttaaaatttaaaaaaaaaaaaattagccagtcatggtattgggcgcctgtagtcccagctactcagaaggctgaggcacgagaatcacttgaacctgggaggtggaggttgcagtgagctgagatcaggccactgcattccagcctgggcgacagagtgacactcagtctcaaaaaaaaaaaaaaaaaaaaaaaccaaaaccaaaaaaaaatgtcactggcaaatgagcactttttaatacagtgatcctgagagggactggctggccactaatcaccatctttgacagagtttgcttctttaatcactgtacattccggtggccatttgcccttactttacaaaaatgaacaaagcaaaattaaggtgctgaaagcaaacgatgagtatcggtctcaagcttcctatagaaagatggaaaaacaacagaaaagccaagaacagtcacaaggaccatcactgagtggacaaagccaactgcacattcaactgtgaaggaaatgaaacaaagttcaggacgatgccaaaaatacataatcaatgattgtatctaaaagatgaggcagcaacagagacttcaaaggtgttcagcattcttggaaggaagagagcctttctttttatgcgtaagtttacttttttggccggtgcacttgtattcaagaataccttagtacaaaataggagggctgagtgcaagtaatgaaacagaatttcctccagagtttacccagaggcatcaggaattcacagtccaacgcccaccatccaactgattcatcagtacccccagggactagatttttcttcctcctacagccttgagctggaaacaaaaaaaaaacaaaaaaaaaagaaaagaaagtacctacataggtcagaaagaagcagtgcatctgagttcccagacagtaaaattacttaacactctaaggctgtagaactttaagaattcttttctggggggaggcggggggaggggaaagacagagtctcgctctgtcacccaggctggggtacagtgctgcgatcttggctcactgcaacctccacctcccgggttcaagtgattcttcagcttaagcctcccgaatagctgggactacaggcgcgtgccaccccacccagctagtttttgtatttttagtagaaatagggtttcaccatgttggccagcttggtctcgaactcctaacctcaagtgatctgtccgccctggcctcccaaagtgctgggattacagaagtgagccaccatgcccggccgaactttaagaattcttatatgcagtttaattttacagagagccacatagatactcaagaaagtctccagctggccgggcgcggtggctcacgcctgtaatcctagcactttgggaggccgaggcaggtggatcacgaggtcaggagatcgagaccatcttggttaacacggtgaaaccccgtctctactaaaaatacaaaaaattagccgggcacggtggcaggcacctgtaatcccagctacttgggaggctgaggcatgagaatggcgtgaacccaggaggcggagcttgcagtgagccgagatagtgccactgcagtctggcctgggcaaaagagcaagactccttctcaaaaaaaaaaaaaaaagaaagaaaaaaagtctccagctacctggattcttgggttacaatgctggccaacaaccagactaaaccactgcatcactcaggtaagtctatacaaacacggagagactgggttggctagaggatccatcactttattttcagaaaaagatggccaaagaggggaaaaaatacagaggcattcccacagcacagtgaaaacaattagccatccaaaaagctgaatcaaaaacaatgccaatcagctttcacgcccacacaggtgaggtttcactgtgcaacagcacataaatgataatctaaatcctagagagaaaagtagatagcaccttgtgcttttccttggcaggtggatggcacaggcttggagacttccatgtcatctccgcttttcctcctctaacacagggctggttggtttcacctgcaggcactactgacttcagggcttgctggagaggagatggttgtgctgcagttcacttggtgactataaacactttgatatgctcggcagtcccccaagtcttccaagcaggaaatcaggtcccccccgacttcccacatgggccaatctgcagcacagacaacataacagcacagctaatccgtgaagacggacagtgaatcaaggctgagttccaggccagtgacttgtgtaccaggggcaagatggaaatgccagataggaaatattaaatccattccattttagctcacaaggctcaaatgcgccttccaaaaacacctagaggaatttaggattccataagggatgtattttacaatttaagcctccaagaccacagacgagggactccaggtgatctatccacctcactgcagatcagggtgaaggatcctttgaaacaaagtacagtctcctctcacttaaccctggaccattagaacctctagggcctgtaacgagtatacctttacaaggcaccagcaggcggcagagcagagctcaggacttgagatgactcagttgctcaaaaggtgaaggagaggctctcacttctaaaacgcagaaagacaggacacaggagaggcaaagccaagggggcacccaggagatgcgggagaaggactggtacatttgcagacaccaggcctgcttattctgcatagacaatgtaacatggctgagctgcccagcagagcttcggagaattacgctgattcacctctcaacctgggcggggtacacaaaggactgtacacaagatgaaatgaggattatttttggtcaaatgttcccaagaagggggcaaaagtraaacaaaaggaggctggcagcccctgacacaagactagcaggtagtttccgccgcaaactgaaccttatcagcttaacacacccacacagcagccctgagggcatcagtgaggaggaagtacctcctttggggtcctcttccccaagaaagcctcttcccggagtcccccagtctgtcctggatctccatcatggacaatgagtgctcctctgcacccccccatatcaatggcagtggaaccaatgagaccagcagctgaagtccttctgcctgtgccgacgctggagttgacaccagaacagtgacagtcaaactgaagagttatccagggaagggaggaggacgacttcactggttgcaagaaaataaacctccgagataggtgtccagttaatttcccccaaaaagtttcccagttggaagtctgtttttagaaccgagaaccaggaactgagttacacacccacatgtgcttagacaagtaggcgggtgactttattcacaaactactcaaaaacaggctgcagagaacagaatttggactgccaaactcactgtaccctcatatcgcactctttcttctttgctgcctaccctggagcattttggctgggaggcaaaatcccagtgctattacaggcagtccccatacccctcattccatgcccaccccaccccacccaccacccagaagctgaagccttatgacccgcttggaggaaaacatcctgtcctggttttctgtgttccaatcagctctctaaacacatcctcgacctgagacacagacttcaagccagcctgtgttctgtcaggctgctggtcgccctggagggtggaagagaaaaagaagaaggttccaaaccatgtcactcaaaacaaatcaggcttaatgctcatactatgtttatattctttacattaacaaaatgcaacaaaagacttgtcctggtttttaaaaaatacagaatgtgagttttacgaccttttcta

SEQ ID NO: 17721 - DNA, 119036 bp, Homo sapiens
  misc_feature (1)...(119036): n = A,T,C or G, or insertion/deletion polymorphism (see Tables 1-2)
tgggacacagctagggcagggttaagaggaaaatttacagtactaaatgccgacatcagaaagctagaaagatgtcaagttaacaatctaacctcacaactaaaagaactagagaaccaagagcaaacaaaacccacagctttcagaagacaacaaataaccaaaatcagagctgaattgaaggagatggagacatgaaaaactattccaaggatcaacaaattcaggagctgattttttttaaagaaaatgataacaaaatacattgctagctagcctaataaaaagggggaagattcaaataaacccaatcagaaatgataaaggggatattaccacttacccacagaaatacaaaccgacagtcagaaaatactataaacacttctatgcacataaactagaaaacctagaagaaatggataaattcctggatacatataccctcccaaggcagaaccaggaagaaatggaaatcctgaacagccaaaaaaaggcccatagccagatggattccacgctgaattctaccataggtacaaagaagagctggtaccattcctactgaaactattccaaaaagttgaaaaggagggattccttcctaactcattctatgaggccagcatcatcttaaacaaaacctgggtagagatacaacaaaaaagacaacttcagagatccaggaaaaacagacaacttcaggccaatatccttactgaacattaatgcaaaaatcctcaactaagtactggcaacccaatccaaaagcacactaaaaatcttatccaccatgaacgagtaggcttcatccctgggatgcaagtttggttcaacatacagaaattattaaaagtgatccatcacataacagaagtaatgacaaaaaccacttgatcatctcaatggatgcaaaaaaaggcttttgataaaattcaacatcccttcatgttaaaaattttcaataaactaggtatcgaaggaacatacctcaaaatgaaaagagccatatgtgaaaaaccaacagccaatatcatactgaataggcaaaagctggaagcattccccttgaaaacaggcatgagacaaagatgccatttctcaccactcctttcaacacagtatcggaaattctggccggggcaatcaagcaagagaaagaaataaaggtattcaaacaggaagagagaggaagtcaaactatccttgtttgcagatgacataatcctatatctagaaaaccccatcaactcagccccaaagcttcttaagctgataagcaacttcagcaaagtctcagaatacaaaatcaatgtaagaaactcactagcattcctattcagcaacaacagtcaagctcagatccaaatgatgaattaactcccattcacaattgccacaaaaagaacaaaatacctaggaacatagctaagaagggacataaaggacttctacaaggagaactacaaaccactgctcaaataaatgatagatgacacaaacaaatagaaaaacattccatgctcatgtataggaaaaatcaatattgtgaaaatggccatattgcccaaagcaatttatagattcaagttattccctttaaactaccattgacattcttcacagaagtagaaaaaatcattttaaaatttatatagaaccaaaaaagagctcaaatagtcaaggcaattctaagcaaaaagaacaaagatgtagacatcacaataccttacctaaactattctacagggctacagtaactaaaacagcatggtactggtataagagcagacacatagaccaatggaacagaataaagaacacagaaatacgaccagacacctacaactatctggtcttcaagaaacccggcaaaaattagcaatggggaaataaatggtgctgtgataactggcaagccgtatgcagaaaattgaaactggacccctttcttacattatgtacaaaaattaactcaagatggattaaagacttaaatgtaaaactcaaaactataaaaaacctagaaacaaacctaggcaataccttttaggacatagatatggtcaaagatttcatgaggaagattccaaaaccaattgcaaaaaaagcaaaaattgacaaatgggatctaattaagctaagaagcttctgcacagcaaaataaactatcatcagagtgaacagacaacctacagaatgggaaaaaatttggcaaactatgcatctgacaaaggtctaatatccagcatctatgaagaatttaaacaggaaaaaaaaaggcaagaaaaaaacaaataaccccattaaggagtacacaaaggacatgaacagacacttctcaaaagaagacatatgtgtagccaacgtcatacaaaaaaaaagatcaacatcactgattttttgaaatacaaaatcagaaactgatctttggaaatacaatatcaaaaactgatcttttgaaatacaaaatcaaaaactgaccttttgaaatacaaatcaaaaccataatgagataccatctagcaccagtcagaatggctattactaaaaagtaaaaaaataacagatgctggcaaggttttggagaaaaattaacgcttttacactgttggtgggagtataaattagttaaaccattgtagaagacactgtggcaattcctgaaagacctaaagacagaaataccattcaacccaaagattctgttactgagtatatactgaaaggaatataaattgttcagttataaagacatacagacacgcatgttcattgcaacactattcccagtagcaaagacatggaatcaacctaaatgcccattaatgatagactggataaaggaaatgtgttacatatacatcatggaatactatgcagccttaacaaaagaacaagatcatgtcgtttgcaagcacatggatggagctggaggacattatccttagcaaactaatgcaggaacagaaaaccaaataccgcatattctcacttgtaagtgggagctaaacaatgagagcacatggacacatagagggaaacaacacacactggggaccattggagggtggaggataagaggagagagaggatcaggaaaaataactagggggtattaggcttgatacatggatgatgaaatgatctgtacaacagacccccaggacacaagtttacctgtgtaacaaacttgcacatgtatccctgaacttaaaagttaaaaaaaatacccagaaaggacaaatttatagagacagaaaattgattattggttgctgggaatgagtaggaatgagaattaactgtaaaccagcagttagagttacagagaggtaacagaaatgttctgaaattagattgtggtgatagttatgcaatacagtaaatttattaaaaatcagataaatatttaaaacgggaattttctagtatgtaatttatatctaataagtctgggttttttaaaagtatatgataagagaaactagagtgtgactataaagactgcttttaaagaagtattatggttgtacgccgggcgcagtggctcacgcctgtaatcccagcactttgggaggccgaggagggcagatcacgaggtcaggagatcgagaccatcctggctaacacggtgaaaccccgtctctactaaaaatacaaaaaatgagccgggtgtggtggcgggtgcctgtagtcccagctagttgggaggctgaagcaggagaatggcgtgaacccaggaggcggagcttgcagcgagccaagatcccaccactgcacttcagcctgggtgacagagcgagactccatctcaaaaaaaaaattaaaaaaaagtaaaaagaattatcatggccgtaaaggcaaatagagaaataagtgatttgtagaatttatgttgtcagtgatatagttttttttatttgttttatttactgataagaaattttacaacttttaccttatgtccccttcatttagggcattttgtgggggcgcaggtattttcgaattatacatatatctcagggttcttgaatttctgcgtttgtgaaaatatctatctcctttacaaccagtaacaactgggaagagtataaaaatctgtttatatactctttatatacttttagggtacatgcacatgtaccctaaaacttaaagtataataataataaaattaaatttaaaaaaatcattgagtcacagtaatttcactgaggactctgaagacattgctttactgttatttcagcattaaaggggaagtggaaaatttgctttttccctctttaatacgtgacttgatttttcaactgggtatcctatagaattgctacttttatagttaattaccatgaccagtaattaactatattgatcttcattgacattcattgtttattcaatacttcctctgcaaaatgaccattataaattatagatttctatttttagtttcaaaagactgaatgttttgaccatttgatttgttctattgttttacttcttagggatactaattatctctatgttgtatgtagttttaactccctgctcttcactcatttattttggccagattcttctccctgtgattaactgtgctatctgtggaatgtcttcatatttctcctcttttctagaataggcttgatttttaaatcattttctcactgatttatggcagattactatttgttgtttaaaataactctcttctttgaggttttgtgtctcttatttgagcttttgtttcagataacaggttttctttaatttatttgatttgttggagtaatgcttattcataatattcacccattttctcatgaatttttttcatattcatctgccatttgtttccatggttctgtcagtgctttttcttgtagtacttacatgcatccacgttgaaccccttccagatataacttatcattgaatgggggattttcttttttttttttttaaatttttttttttaattatactttaagttttagggtacatgtgcacattgtgcaggttagttacatatgtatacatgtgccatgctggtgcgctgcacccactaactcgtcatgtagcattaggtatatctcccaatgctatccctgttaaatattttttaaaagatggcattaagaaggggtcaggagagtgaagtgccctttatatctcatatgcttcattctgtgttctctaaatttaacaacaatcagccttaggtatcactttgcaatagtctagtttttctaaacctccttggctttaactaaagctctgtctttccatgtgtcttagtgcttttttttttttttttttttttggctgtaagagaatatcacaaactgggtaatttataaacaatagaagtttatttgggtcacagttctggagctgggaagtccaagaccatggtgctgacatctggcgagggtcattccaaagcagaagtatcacatggcaagagaacatgtgagagacaaagagaaaaggggcgctaaacttccatgctaacagcattaattcattcatggggatagagccttcgtgatctaatatcacctcttaaaggctccacctgttaaccatggtgcaatggcaattaaactccaacgtgagttctggaggagacattcaaatcacagcactataattatttttattttgccgggtctgtcccacagaccctggccaatggatgaaatgagtactcagacataggtatgcagtgtaagagctactaggtgactgcctggctccagtgaccagagagcagcagtccggagaacttgcttttattcagtgcaggcacaatgctgaaaacctggagcccacacaacctgtaggtaattaacatttcttgttcccctttcagggagtctcatgcgcacgcgggatgttcaaaggtcagttcctggtcaacataagtaaacaagcctgtttaagataaatccccccatactgccttgttcctaatccttgccctctgcctcagggttatagaacagccgccttcagctattctcccccagggctctgcagaaccttcccacctttcagcaggtttgcatcctttccctgtagtttttcccaccactctaacagatccctcacattattttttatttattttatttttttaattgagaaagtctctctctgtcacctaggctggagtgcagtggcatgatcgtgactcactgcagccttccactcctgggctcaagcaatcctactgcctcaggctcccaggtaggtggaactgtaggtgtacatcaccacacctggcaattttttttatattcagtagaaatcaggactcgctatgttgctcagattattgtttattatttttattccttgcaagatcgaggagactgtgttgttcatattgtagttttggtcccatagtctccactatactattccagcagcctgctttacataaaaattattcctctttgtttctctcatttcaagttagtaatacaaaataaagatctaatgtgtggcaagcagcacaactactgagccggattcttttttccaagtgagggaattctgatggagctcatgatacgatgtctattttggggtaactttctgagttaatatttgtgtgtaccttctctccaaggaaaaattttactaaaattgacaattctatctttagagattgtaattaggaattacaattgctctcttgtcaaaggtggagtcatctttttatgaaattgttttccattgattttagaaagattactttttccaccattttatatttgaactacttaaactaaattttgtgaatgttaaatttaaaatactttcaggaaattgaaaggtgaaaatatccagaaaaaatgtgtatgtgaatttcgacttatactgtcgaagtagcgtgtggactctggatctagagacatgaattggggcctcttttatagaagtgcttctaagaatcatgaaatccctgaacttgcatgggcagacagcattttgtgaaaagtaaagcaaaacataaaccaaaaaatagatagtgaaattggctgagaaagaaagttcaatggtatgggagcagaaacagaagttaaargaggagaaatttttaatgagtgattttaggctcagtggtgactttagaacattttctctgatgatgagggtgaaggcacattgcagttgattgagaaatcatgtggtggcaagaatgaaaacaaaaaaagagtgaaatagaatgaggagaatgtcaactaaagaaattttaattttaaaatatttatttgcttacttttattaagacgttttcataaaccaaggagaaggtgctggaagaagtagaaaattgaaaaaaaaaatcaagaaagagcacagttgattggaaagacttacgaggctacagaaagcggtagaattcaggacagaagggaatatgttatttatctctgaacagcaggagttgtagrgataaagtcaccctctggcattagtggcaaggcttacgaaagcatatctagggaagtgtgtaatctttgagtccgtatctggaggaaggycaagtttcttaatctcatttttctcaggaaggcatgaaatttgatattttgctaagtgtaaaggaaaagtgaagtttgattggagcttgaagagattaccaaaaagcttagattagatactgaagggataaataacaagtaaagagattggcctcttaaggggcctcaattaaattggaaataataaatttgtagtgcagaccctgtagcatgtcactgtctttcactggccccagcagcccaggagtagaaaccaaaagtttacatcacaggtttgatgaaaattggcgatttgaaagacagcccccgcagaagataatggaaagtttggtgaacctgtgagtgatcatagtagttctaattgttaaaactttgtctcctggatagtcaggaagaataggaaccaaaacttggagaaaatttaaagaccaagtgcaggactgcctacaaaggtaaaataatttttaattggtcttaggtaaacttctgacaaattctttcattctcaattccaactactgactattaatctatgtcccatattgtctgtcagacatttttaaatgaagatatatcctctgaaatattacaggaccacgttttaaaactttatgcatttatgtctagaatgtgtacacttgagtggtggtttcttaaaatcacagcatgacaattatttatgaatagtgttcctcccaaatcagaggaattcacatgcaaatatagttaagttgcccatagttgtcccaaatttttgaaaggcatcagtgaaatgtaaaagaagcagcttagaagtttccaaccctttaagtcttaaatgagtacttgaaatgtgatattgaaacaagaggacagctggattacttacgtttaagagtagttgagccaggtgcagtggctcacacttctaatcccagcactttgggaggccaaggtgggtagatcgtttgagcccagggatttgaggccatgctaggaaacatacggagaccctctctctacaaaaaatacaaaaattagctggactgggtggaacatgcctgtggtcccagctgtttagaaggctgaggcgggagaatcacttgagccctgggggttgagactgcagcgagcagagatagcaatactgcgctctggcctgaaacatggcaagatcatgtaaaaaaaaaaaaaaaaaaaaagaagagttgagggtaaagataactaatcatgagaaggaccatttattttatgtcgaataatgaaaagttttcacttttttcattattccaaatttgaagtttgtatgtcttaaacaatgctgataatcatgccactgtatttagaatcattgttaaacagttcttatcccatctggaaagattgtaaaatgtgtatgttataatgtcagtattatatatatyttttatttatggatgctacaattgtgttcttcccctatctatgactctgcttagattggtgtgcaggccaaatctggttacttctcaygctctgatttaagaaactttatatttatttctgatagtgatgcacaccattatgtcaaatttagaatacacagctattaactttattgctccccagatcaaagtcagcagtttttcagtttgttggatttacaacccatccttgtaagacttgacattactacgttcatcagacaacaaacagaaggaatcaatattattaaaaaatggatggcagggaaaaaattcaactctagaacagaggttgggttaaacgttaaaatacttaccttaaacatcttatttctctattttaaaatctaagaatccaaagtatattctcatacttccaagctacattcatgtcttttgttaggagttaaaattggatacagtttgattctgtgttcaactcagaaaagttttcaaaaaatatgtgtctgatagctcaacagaaacataaaatactgagaatattctattttagaataagagtttactagcttcaaccctgacacagatgttacctcataataattataaccattttttcttactttctgatttattaacatgacattttctaatttgaagactcagtagttccagctgagcttattctcagcatctaaaattttagtgtcaaaagattaccaaatgattatttagtcagaatctatttcaaaattgtgtaattttaaacaagatatctaattcactttttttgtttmgaatatattttttcacatgtactatagatcctatggtgacgaaatattaaataatttagtgacttttttatatatccagaaaacattggcttttttttgaagaaaaggtttttagtgaatatcagagacccacatttacctggcttactccagaactacaatatgtgactttttcacagcaaacacygcatctctgaaaacttattttcctcctaatattttaatgattcctttcctgaatcctcatagtagccatctcaaatttaattattgcattcttttcaatgtcttatttctaaatcaaatgttctccaactcgctgtcttcatatccttacttccctgcttttattctgtccttctcagctatagcaattctacatatgatgtaagagtcaataactagccatgttttgctctgaccaaattatcaatgacctcttcatagcatttcctgtgtcaactaaccgggcattaaccatataggtattaattatgtagaaataggtataataataacatacatatttgtatactattttagtttgctaagagcctttatatgttttctaatttgattgtcacaaatgaatacagtcatgactgcatgcatgaacaaattaatggatgtcattaatatgtggaaagcaataaatatatggtaattgtttagaaaacttcttttaacttaagctctgataatgtttagttcaacctaatgcattttgaatctattactgttgaaaagtgaaacagtgttaggaaaattacaaggtccagtgtctaccctcaatttctaaatgagagtaaaagtcatagagttagacttggatttaaacctaccaaggtcacctaggagctctcataattaggggaatggattgtttttcttctctgaaataaaatttcccttctagcagtaacgaacacatggattttaccaaaaattaataagattgaaaaatctatatcaaaaacaggctatactatgtttttttttttttttttttaagatggagtttcactcttgtcgcccaggctagagtgcaatggctcaatctcagctcactgcaacctccacgattctcctgcctcagyctcccaagtaagtgggattactaggtaatttttgtattttaagtagagatggggtttcaccatgttggccaggctggtctggaactcctgacctcaagtgatctacccaccttggcctcccaawgtgtgtacaatcttttatctttaattaacatttataatttaacatttgttaacataatttttgggctgttatctaagtttttaattgtatgtgtcctgagtccattttccttatcagcacctgaagatgacgttcttttcagaggtcctgttcaataaaatggagaaaatatttagaagtttctctgtatatagctgaataatagagtctcattgatgttggtgcaatgatgatggtgtgtgatccattaggttctctctagctaagtaatgctcctgtacaccaacctcacagcatctgtcatccaaatttctttctcagctaaattgcaaattagtacatattctgaaccttccggtcattttttcaagtagtcaagcctcaaataccaacagtctatattaccttttattgagctgatatgccttctcatgatcttaggattctgtcactagagaagggcttaaaagtaagcttctttctcagacatgcaaattacagtgcagatggttaagtgcacctcgttatgctatctttggaaaagacaaggagaatggtgacccatagaattaataataggtgaaacaaattaagcaataacttgccaggccaaaaaaaaccaaaaaaacaaaaaacaaataaagtgagcatcataagtagaagaaattttattccacacacagtgagggttgcacatgaatgtagaaaagagaagagttataaaaaatgtaaaaattctcttctcatktggcttttcaaatctctagggaaaaaataaaccatttcataagcaatgagggagaatctgactatcatttgtggaagaaaaactagacccttcctctacactaaccaagattagaaaagaaatacaaacacactagaataaatgttaattcatcaattttattacctaattttgacatgtgatatcaatacagaaaggtaaatgaaatgatacgtacagtttaagaaattgttataaaataaacaactatggaaccactcagatccagaaatagatcagcggaaatagatgggctcccagaagcccatcatctgctcctccccaattacaacgccatcccttcgcaggaggtaactactggtacaccttttgtgatgagcatgtacttcagtgtttctttggctttatcacatctatgcatccctaaacagttctattttcaactttatgtgttttgtaagcattgcttcattgttttcaaaattatagccaggagattgagttacactgttttctacatctttattttgcacattttcattgctgagtaatatcccattaaaacaatatactaaaacagtaatcctcaaagtgtggtcggctgatctcttgtgttctcaaatctttttcagggggtccacaaggtcagaactatttttattataatactataatgctatttgactttttttattgtttcatttgcatgaatgtcgcaaagtaacaaagcaggtaacacagcttctgacttaacatgaatcaatgcagtggcaacaaaccgtcacagtagccaccatgcaatagtttaaactgtgaactaaactcatgactttttcatgaaacactatttttactaaaatcatcactgacagttgcgtgtaatcccaacactttgggaggtcaaggctgttggatcacttaagcccaggagttcaagaccagtttaggcaacatggcaaaaccctgtctctacaaacaaacaaaacgaaaattaccccggcacggtggtgcatacccatagttctagctacttgagaggccacggcagaaggatcacctgagtccagggaggtcgaggctgcagtgagccatggtcgtgccactgcactccggtctgggggatagagtaagaccgcaactcgaacaaaacaaaaacagatagatagatagatagatagatagatagatagatagatacatacatacatacatacatacatacatacatacaaacatacatagatagacacacacatattctcaagtctaaactatatatatcatgtatataatatatgtaatttctaatgagataaataattatatgaatcagtgcactacaatatattttaatttcattcttaagtggtacttgggttttttccaatagggttgtaacgaacatttctttgaagattatggtacatgtttcttggtacacatgtgcaaaaatttctctgagatacttacctagaagcaaaattactgaattaccttatctcctattgctaggtaattatttttagaaatactttatatagtctgaatactaggccttttcacattaggtatattatgagtattttctctcattctgtttttttctgtcaatttttcttactaaaacattgtttatatgatactgagttaggaaagatcctttccaaaaaaaaaataagggcaggaaataaaaccatagaagattgataaatctgagtacaaggattttttaaaaaatcatattattaaaataccaatatacatagtcttcggagggtgtatgtgtcaaggaatttatccatttcctctagaatttctagtttatttgcgtagaggtgtttatagtattctctgatggtagtttgtatttctgtgggattggtggtgatatcccctttatcatttttcattgcatctatttcattcttctcttttcttctttattagtcttgctagtggtctattaatttgttgatcttttcaaaaaaccagctcctggattcattgattttttgaagggttttttgtgtctctatgtccttcagttctgctctgatcttagttatttcttgccttctgctagcttttgaatgtgtttgctcttgcttctctggttcttttaattgtgatgttagggtgtccactttagatctttcctgctttctcttgtgggcattagtgctataaatttccctctacacactgctttaaatgtgtcccagagattctggtatgttgtgtctttgttctcgttggtttcaaagatcatctttatttctgctttcatttcattatgtacccagtagtcattcaggagcaggttgttcagtttccatgtagttgagtggttttgagtgagtttcttaatcctgagttctagtttgattgcactgtggtctgagagacagtgtgttataatttctgttcttttacatttgctgaggagtgctttacttctaaataagtggtcaattttggaataagtggggtgtggtgctgagaagcatgtatattctgttgatttggggtggagagttctgtagatgtctattaggtccacttggtgcagacctgagttcaattcctggatatccttgttaattttctgtctcgttgatgtgtctaatgttgacagtggggtgttaaagtctcccattattattgtgtgggagtctaagtctctttgtaggtctctaaggagttgctttatgaatctgggtactcctgtattgggtgcatatatatttaggatagttagctcttcttgttgaattgatccctttaccattatgtaatagccttctttgtctgttttgatctttgttggtttaaagtctgttttatccaagactaggattgcaacccctgcctttttttgttttccatttgcttggtagatcttcctccgtccttttattttgagcctatgtgtgtctctgcacgtgagatgggtttcctgaatacagcacactgataggtcttgactctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgatggtctttacagtttggcatgtttttgcagtggcgggtaccagtttttcctttccatgtttagtgcttccttcaggagctcttgtagggtaggcctggtggtgacaaaatctctcaacatttgcttgtctgtaaagtattttatttctccttcacttatgaagtttagtttggctggatatgaaattctgagttgaaaattctttcctttaagaatgttgaatattggcccccactctcttctggcttgtagagtttctgccgagagagagccactgttagtctgatgggcttccctttgtgggtaacccgacctttctctctggctgcccttaacattttttccttcgtttgaactttagtgaatctgacaattatgtgtcttggagttgctcttctcaaggagtatctttgtgtcgttctctgtatttcctgaatttgaatgttggcctgccttgctaggttggggaagttctcctggataatatcatgaagagtgttttccaacttggttgcattctccctgtcactttcaggtacaccaatcagacgtagatttgatcttttcacattgtcccatatttcttggaggctttgttcatttctttttattcttttttctctaaacttctcttctcacttcatttcattcatttgatcttcaawcactgaaaccttttcttccagttgatcgaattggctactgaagcttgtgcattcgtcacgtagttctcgtggtgtggttttcagctccatcgggtcctttaaggactcctctgcattggttattctagttagccattcatctgatcttttttcatggtttttaagttctttgcgatgggttcgaacttcctcctttagctcacagaagtttgattgtctgaagccttcttctctcaactcgtcaaagtcattctctgtccagctttgttccattgctggtgaggagctgcgttcctttggaggaggagaggtgctctgatttttagaatttccagtttttctgttctgttttttcttcatctttgtggttttatctacctttggtctttgatgatggtgacgtacagatggggttttggtgtggatgtcctttctgtttgttaattttccttttaacaggcaggaccctcagctgcagttctgttggagtttgctggaggtccactccagtccctgtttgcctgggtatcagcagcggaggctgccgaacagcgaatattgctgagcagcaaatattgctgtctgatcgttcctctggaggtttcgtctcagaggggtacccagccatgtgaagtgtcagtctgctcctactggggggtgcctcccagataggctactcaggggtcagggacccacttgaggaggcagtctgtccgttctcagatctcaaactccgtgctgggagaactactgctctcttcaaaactgtcagacagggacatttaagtctgcagaggtttctgctgccttttgttcagctatgccctgccccgagaagtggagtctacagaggtaggcaggcctccttgagctgcagttggctgcacacagttcgagcttcccggctgctttgtttacctactcaagcctcagcaatggcaggcgcccctcccccagcctcactgccaccttgcagtttgatctcagactattgtgctagcaacgagcaaggctccatgggtgtgggaccmtctgagccakgcgcgggatataatctcctggtgtgctgtttgctaagaccattggaaaaacacagtattagtgtgggagtgacctgattttccaggtgccgtctgtcacagctttgcttggctaggaaagggaattcctgaccccttgcgcttcccaggtgaggcgatgcctcaccctgattcggctcacgctgggtgtgctgcacccactgtcctgcacccactgtctgacaagctccagtgagatgaacccggtacctcagttagaaatacagagatctcctgtcttctgtgtcgctcatgctgggagctgtagactggagctgttcctgtttggccatcttggacttatcaccatttgattcaagtgttttgagaagcttaaatgtatttttagaaggaaattattttattcaatccagtgatagatacaacaataacatttccacaattttgttttagtaaataacaaaaacaatgacttgagtgcctgtgatttataacaaaagggtattctttttcacagaatctatgaatttcataaagtttatttcattttaaagatatttcaaaacatttctgagagttccttaaaactcattttgtttatttcttttaatattactgaagaggagttaatgttggctttataatttcaaattttaatatcttagtttactgtttacaattttacaatacatttatagatggaatactaaagggtcaggcatgattatatatatatttttaacgaacttaattctgagaggttcttttctaatcctgattttagttttcagatgtcacacaattagtgaattccagaggcaggattcttcattgttattcataaaaaattttggtataaaaatgaatgaattataaaatataaaaatgtttgkttcctggaaaacattgagattctacaatgcatttcttatgtaaataacactgtttctttattgaaatagttttctactagctgattttagaggccctaccttgctgatttttcatgttgtatgaatatagcaagggatttggatgcaaggagtttatttcaagatgtaaatataatcatgtcagtaaccagttttctaacaattctccttaatctgccttagctagtagttattctacaaatttaagaaatgcagtgtttttgttatagattttaaagttagcctggaacatttgatacactagtctccactactgtaaaacaaaataaaatgaacaaataaacaaaaatctcttccatatgatgtaaaaacagccagagaagactctttggttaagatagtttcatgtgaagtaatgtgtaaattcgctgtaagcattatgacagacaggaaagaactaatttacattttgagaaagcttctgccttgcaaaggaattttcttaagataatttgtattcatatctaaataataaaaggctcaagattaagcactggaattgccatttatagtgtaaagaaaaatgcaatcttgagccatttatgttagttccattttttttttttatttttctgaatcatcatcttctttgaacaattattcaaaagatagtgttttctttttgtcctttgtggggtatcctgcgctttggctgatgattaaaaacctgccatttcctttcatcctcattagcatactcattgttctccttagttgggtgctttttggatgccatccttgtcctgcagagagctgcaggattccatcagatctgttcaggcacctgagcctaattaaggaagttctcacttctctttttatcatagatttgataaatgaggatgtttacagctaagtgtcttaggattgagtgaatactttaaaatagatcaatgctaaagatcataaagcatatcacatatccacattacatatctaataaagagaaatagaacatgacacattttcatgtaagaatctgtttattcatagtgcccatgatgtggtagagactgcatgccatttatagcgttatagttggagtagtgtaaactgctacattgtgaactataacaactgaactgaaaaagaaaagaacaaagacagaaacagtyctggacaatggaaattaaagaagagtgatttgtattcttttgatcctccggtttctctatgtcggcttctctttggttacctcaagtatcattagtattacagttgtaagaactctggctaatgtaagcagcaaagaaatgtgctggaagaatatctgatcccttagaaaatcattggggaggctgaagagcccagctagagaaaagggcatgcaggaagcaaagaatgctaagcacacaagcccggagcctcctcaagttaaggaggttgctaatagcacgaccagcacaggatgtgagataatcagtcttccactggactctcattctggacattgctatgagttctttattacctattttaacatcttcgtattattttttcaagactcaaaatccaggcaggattaaatagttggcttgacccaggtcacagcctacactgcagttatcaaggaacagacagagagccctcggtgctgtcagccttgtgatggggaaatggaccctgcttccccaaaaggcatttgcaaggagsgatttgaaactggaaggatctcaagtgtttagtcgaaagaccatggcccatgtcagtcatcactgtcatatccacagataatagagtgttggaaagaagctgagaaacaacctgggttctattcaaattcagttcttagtgttgtgtgaccttctctaagcctgggtgtcctcagttttaaactgggataatattgttttgcccaaaatatctcatttcattgtaaagagtgaaatgagataatttatgcaaggtttctttccatttcttttcattccaaaaaatttataggtagtaatggtctacctgtgtgagcaaaatacaaaaaaaaaaaggaagaagttaataagttaataataaccatttatttgctaagaaatatataaatgtgagrtatgaggtattatcagcaacgtttttwtttaaaaatatatagaaaagatatatatttatttttcattgtttgaaagttaagacaaatggatgaaaaaaacagtgctatgataaatatgaaacaattaggagagcagaaaattaatgttgaggtattcccctgcattggggatctttctcccaatccaactatccatttttgtgtgtgagggagttgacattcttataaaaccccaactgtagaacgaagtgactggtctaacaatggmtctttcaccgaacgtgacccatcagaactaattcctaaagcttttaaacttagaaccatctgtaaaatgtgctgctggtcagaagcagtactgtgtggtatgcatcattgttgaagatatattcagtgtgtctgctcattgtggtgctagggtaatccctgaagcaggaaaggaaagtccacatctttagcaagtactttttccatagaggattaaacattccttcctggaagagatcaggtgtaatcactgtgctgccagattactggctgggccatctcaggagttttcagtatttgtctctgctatttgcatattagaaactcaggagtaccagtatccagaccagcttgctgagttttcagcctctgctatttgcattttggaaactcaggagcaccagtatccagattgtcttrttgagaaaagcctatgttgttcagcccatgaaccacttcagtctcctctgcatggccatttcccatatgctatggctagggcaaaagctgactgactttgaccagataggtcatcttgtcagccagattatcgactctacatagtggatgctgtctagtggacatttgcacagaaagtggatgttttcacattgttgcccattttgagagtttcagccacatatcattaccccagaatcgcaatcttgcaacattaacatttgatggtgacccttatgtcaccagttctcccagagatgcagtattgttttcggattaccatcctggtggggaggggtcgtttcagtggcttccatttagtccttctaccataagagttttcactccatatatcaggaaacgaatatggattctgccaataattaaatatatatcttcttagttcgcattttgtatctgtagaaataacagccagttgggtctacagttccgtaggatttactatgagatgcagttgggtcaagactttccatagtgctcaggatggtcatagttctgagcctcaattaatgagccccagtacatagctttgttttctcactgagatgccctctagacatggcttcaaggaaggttttataatataacccttgttgtgagctgaaatgtggcccccaaatcctagccctgaacatctcaggatgtgactgactgtatttcgagatgagacctttatagaggtaattaagctaaaatgaggccattagggtgagtcacactccaatctgactagtgtccttataagatgaggaaatttgaacacattaaaaacacacaccaggggcactcatgcacggagtgacaaccacatgaagaaacagaaagaatgcaggaatctgcaggccaaggagaggggtctcaggggaagccagagctgctgacaccttgctgtcggtctttgagactccagaattgtaagatataaatttctgatttttaagccactcagcctgaggtattttgttgtggcacccaagcaaattaatacaattctgctgctataacaaagcagcactaacttaagtgctgcatatatatatatatatatatatatatatatatatatatatatgataacacaaatgagttatcttatatttctacaggttagatgtccaaatgtgtcaccctgggctaaaatcaagttgtcaacgtggctgcattcctttctggatactctaggagaaaatctatttctctgccctttccagcttctagaggccacccacatcctttgttctgtggtcttctttcttgcatcatcaaagtcagcaaccttgcatcgttctggccattcttcccctcattacattattttctctgaatctcttctgcctccctctgctgcttttaaagatccttgtgactgaattggactcactcatataatccagagtaacttccctcttttaatgtcatctgaacgagcccattgtaaccataattccatgtgtaatcttagttttcctttgccctgtaatgtaatattgttctgggaattcagatgtggacacctttgtgaggagggcattagtctgcctaccccagtcctaatagctaagatgctgggttgcttctctaggggccgatcattgaagaagtagtggatttttgaactggtacagtttttgaactaagatgttatgaatctccacaataatgagaattaggtttctcctcagcagacttgaacatttttggattgtataagccaagtagctcattaagaggccacccaacattcctagaccataaatatttatttcatttttaggtaattaatatggaggattcactctcctctgtctcacaaatctcctgctagcctaccagtctgccaaacctaatcaggaaccagaggtcaggggagtcatttgattctgtccaaaaagatcatccttttggagaaaacaaaagggtgaagagtggatctggagtgataaatgagaaaagttctatcccccaacagagaccaggagacagaagtcttatccttcctaatgactacttttcaaaggaatggctttcaggtccttgaaaaaaaatactcccaggtcattgaagaagacactcctaggtgataggaaacatatatacatctcaaaaggatagagaaataattcaatgttgtaagcccttttttagtaaatgttctattaaaggagtccggggacttattgtcaggtattggctagaacaaacagtaaattcaatgacagtcctgagctatcctaggcaggaacccaaaagggggttgggtggtctcagagatatggccttgagctgctagaagccttgttaaggtttggtgattgcttcttgaagagtagataatagaaaacaaaacaagtttggtgaagtctctcagtgcaggtgtttaagtggagtgtccctatcaatcatttttacagttctcattaccacattagaatttgccaatgagtggtgctcccaagtgatttgggaagcaaaagagaaaaagacatgtattctctgatagcaggaagatcaaacagcaaatgacaggtttgagctttggaagtgcaaaccaaaaagtatctgagacaggtctcaattaatttagatgtttattttgccaaggttaaggacattcctggaaaaaatgaacacagtcacagaaaccatctctggtctgtgactttctccatagatgatattgagggcttccatatttaaaggggaaaagctgactggaggagggtatggcaatgcacatcttgcaagagaaatggagcaggtagagggataatcaatcatatattcctctcttgctcactaaatctacactttgcataagataaagtgaacatgaaatagctacctgtggagatatttaaccttttatctgtagctatctgcttaggaacaaaatgaaaggtaatttcagctttcaacttaaattcttttttcttttggcaaagttaattgggttcctgagttcctatttccctttcacaaaggccatcttggagctttaagcagtagtttatggagatatttggaggggaactgaagatgtatagaataagcaattatgtatgtttatgaaggcgacgtgagccatgtggcttagaacatcacagaacatacattctagttcatgctctctcactagccaggtggccctagataatttattcaagagtctttaagttttctcattgcaaaataaagagggtttgctatgagaataaaaggcaatcgggcatatgaaattgctataaagtcaatggtatccaccttgcaacaatccttttggctatagcataaattcttttctctcatttgggcccctaggctgatattccatcatgatttcacagacttctggttaagaatttgcttaatgcattttgctctggcttaaattaattgacacttttacaastttgaaactcatttaaactacatgggtctttcctacaattctgaagccatagttccctaaacacagtgcaatgtgcatttatgtttttaaaatagcacataaaagtgatctcatattcactttcatttccttgcatttttgtatcttcttagttaagacatcatcacgaggaaagggtgaattgtcaaatgttgcttgcaggagacagctgatcttgcaaggaaattagtcattcgtattttgggcatatgttatccattctacttccctaactgtctaaggacagtgtgacttttagggtcttaggtatgcttacttgccttttagtgtgaggttgtatattaatctagctaggagctgggttacgtctaacatttcctgtagatacagctgtcagaagctaaaattacctgtagtgtctctttgttgcctctactgtatttaggttcccctacaaacttccctttcaaaaaaaaccttgcatctctttcacctgtcatccactgttatcatacgggagctctgttgacggaggggtgagatgtgggggcggggtgaggtgttctatagtcttctgattaaatctcagtcttttagtgggcccttgtccccggactgtgacctgtgaccttcrtgagcgtttctaaacttttttttttttttcctttttctctgccaagttgaactgcagctggaagactagagggagcgagcattgaatagttacccttcagctgcctagctaagataacgctctgataaactcttttcactggggagtaagcctttgttacaggaaatgctctaygtatattttaaaatcattagatttcccttctctctgccagggacatcaggtgatattttttggtatatactgtgagaaccaagttgtattcctggaagtaaagcctgtaagtgtttagggggcgccttgaagactgcagcccccaggaggctccagtgctcacactggtccatactcagcctcttgccaaattcctgcttaggtgttcctgccagtttgtggttccactggcatcagctgcaggtgatctggtgtctgctgtgatgctctgtaatctcctctctctcccggtttcaggctggtagtttccttgagacctcagttctctgatgggtccaagacgtcattgatttttagtttctccagcttttttcgtggtgtcgagatatgagtgatgacttccaagctctttagatgttgaagctgcaacyagaagtcttccatgaactttcttttaaaaatagacagtatggcatagtgcagtgtttctcaaaagaaaataaatatattgatctctataccttattaagtgttgatatattattttattataattttatgttaaaatagagaaacacgaatttagacctaaacactgtaagcctacasttcttaaccaagtttttgaaatataatgcatatgttaattaaattttaaaatctcgcaaaaaaattaaaattttaactaacaccaccaatttaagattgtgtgggcaagccaaaatattattataggtttaatagaaggaagatactattcaattctgatactgtccttggtctgtttctgtatttgacttcaataattctcatataggaaagttctgtttaataaggctatataaaatgttactggtaccttcacagttttctgcttatgattatcaaagaaaaagctctgccaatatgcaatttttcaatgtcaattttattaaagaatgttttgataattctgtaaatgctttataatcccacagcaatatgtgtccgttgcagcattattaaaatctgtatttatatcactatttacttattgctttgaattaagaacatgaaaaattttatctcgaaactttatcatatatatatcatacaataaataagtcataatgtattaactatatattatgactaacaacctgctgtaactttagacatacaaaaatacctcttaatgagtgtaaaatgttaamtcttcttttgagttcagtatacctgtaccacagtgagtcctaggacatttgaatcaattctctcaagccatttgyctatttgattatgaatctctgtttggtcactgggcataatcttacatggacctcattctagacacatatatccataagcaacaaaaataaagtaattgggatccatcacaataactatgaacaaagtaactatccacatgatctggaatttgcccatatttgtggyttgttttctgtatactgtttttgatggagatattatagtcccctaataatacatatacctacttcagcttaagaaaaaactatattttgccaaattttgtaatcagactgggtttaaataccagctctgatgactcataactctgatctcgagaaatttacttaccatctctaaacattaatttctcaattagggaagtgatatgacaaagttgctgtgaagtcaaatgaaggaatgaatgcaaaatcccaaccctttacatattacctctgttctcaattaatcattggcttgaactgaacatttttaacatggttccctgctaaaggtgtttttacatatagtaagacctaatagataatattatgttacataatctataattattatatataaaactatataaaattatatagtacctatttagacatataaaaagggaagttttttaatgaaaaattagattggctgaagagtgtggaaatcatcacatagggaagtggtcagcactgtkgatatacaccaaacagtattacagagacatactgaaaataaagcacactgacagaaagaaacctcattaggatagaattttgggagattggtgtcttgttattcccagagtctgacttttctaatcacgtagyattgtcagggatatctaaattttaaacttcagattttgtacaaaaaaacctaaaaggactatattttaaaataagaagcatgtacaaataattgtaaaggaaaragtgtgagttttgtagtctccagttctgtgtcagtaagaatttgatgaggaatagccaatagcatttatgctggtccaggctggatcaaattgtgatcgtacttytagtcttcaagctgcctggttagaaattatgcagcttactttgatgcctgtcctactactactattagccttttagtggttaccttaagaatractgaataatactgttactttgcatctctcaaagaccgtgcgctgttcccgcatactttcttgcagacgtattgtcttctgaaggatggtgcccatgggcacagcaatttggggcatcttttggtaggaagcatgatttctcctgtttgggcacaaaagagtgactacggaatataagctaaacaccttctcccagaaatatcagttgtaaaacttagctcattaatgtaatgttgaacgttttcatgtgagtcatacttgaacttcttgaatgtgagtaaataacggagttgaattgtataaaaccctgatggatggcagaagggaaagaacatccctttcatctgatccatgcctgagattccttccctctactatactactggaaataaacaacttgtctggtgctctaaaaattaatgctattatcattatagagagaacaggagtgagtgcttttaggttattacttgttcttactaaggcatcatattctttcttcacgtgttttgtgtttgaggctagggataaaggtacaggaaaaaggatctaagaaaaaaactcgaatctctaaacatggagtctttttttttttttttttttttgaggtggagtctcactctgttgcccaggctggagtgcagtggtgcgatctctgctcactgcaacctccgcctcctgggttcaagcaattcttcagcctcagcctcccgagtagctgggattacaggcgcatgcctggccaatttttgtatttttagtagagactggtttcaccctcttggccaggctgttctagagctcctgacctcaagtgatccagccacctcggccacccaaagtgctgggattacaggcatgagccaccacacctagccaaacatggagtctttactcaacattatagtaacgtgaaagaggagatcatgagaattaatgtatgttttagaaggcatagattacttataaaaaaggaaagatcaggctgggcacggtggctcgcgcctgtaatcccagcactttgggaggccaaggcgagcggaccatgaggtcaggggatcaagaccatcctgaccaacatggcgaaaccctgtctctactaaaatacaaaaaattagccgggtgtgatggcacacgcctgtagaacctgggaggcagaggttgcagtgagctgagatcacaccactgcactccaccctggtgagacagcgagactccatctccaaaaaaaaaggaaagctcaatctgctgtaaattatgtgcttgtttcaacaacccttgtttcttttccttttcacttctcttttttttttaaagcggcctaaatggggtgaagagtgagttatctgacaaatttagattttgcaaacctgtgcattgatgagagtgctattgraacacattaagaaagrttttcaacgcaggaatgtgtcatttcctttcttcatgtaccagatgctgaaatactatgagataaagattttaggtttcaattgtaaagagagagaagtggataaatcagtgctgctttctttaggacgaaaggtaaagaaaaaaaaaggcttattttaatgttttttccagaattgtttctattgattgttatgtgtgtactctgtgtgtgtgtgtgcatgcatgtgtgtgatatatatttgtgtgtctgtgtgtgtatgatgagatgaatgctttattgtatcagcaataatttggtttggtttttttcgataatcaaaaaatagggatttctgctaaattttccatgagtgaaaaacatatatgttcacaagtacatatgaaatacactaaatgctttgtagtttgaaccagcaatggggttttttcatataattaagcatattttgtttaaaatactggttttattcaaagtataatttgacatatttcacctattctcctttcataacttttcatggaacatttttggctttaatctaatgccttttattatcttcccttgattatatagcaaatattggctgggtatctactatatgcacttcattgaactagatgtggggaaaggatacaaaaaataaratatagttctttttgtgctcmggaatcttatgatttaaaacatatccccaaataggcataatgtaatttgagcaccttaagtagtatgaaagtactatagataattactagcaccttaagtagtatgaaaatgctatagataattactatgaaaatataggcgaggccaaaattacttctatgtgaaaaaagtctatcaaaaataaatcttcatggagatgctagaaatctgattaatcttgaagactaagtaagattcacacagcatataatgggaggttggcatttgcactgaccaggtaaaaatacttatagaaaaaccatagaactgagattacrratgttttatgcagtgattagccgttttatgcagtgggtaagagctaatcttctgggagtagactgcctgtgttcaaattccagctcccctgctccctagttgagtaacttgactrgttacttacacatttcagttccctaacctgtaaaatggagaaaatactacttgtacctcatgaagattccgtgagaacaaaataagaaaagctcatatttaaaaaaaaagtgatattttaaaataacagggattcatatattgatggttttctgtgtaccaggcaatttacaaaaattatttttaattctcgcaataattctttaaatttatattgtgatcatattttacatatctaaagaaagttcaattcaaataagttaaaatatttgcctragatcacacagctaaatgatgtcacagtcaatactcaaatctagatttcagattcaaaagttgatgctctttcttctttgctaccaaggatgaatatcagtgacatcaggcacaatataaatatttccatttcttactaaaatctgtcttacagacgggttccttaagcataaagctgttagtttcacaaataatcttaatttaattttcattttatatacacattcaactgctgttacaaaaatcaaagttattattttatataataaggaggatcacaagcttattatttattccaaatgttgaagataaagttggccttaagaatatgatgggccgggcacggtggctcacgcctgtaatcccagcactttgggaggccaaggcaggtggattacctgaggtcgggagttcaagaccagcctgaccaacatggagaaaccctgtctctactgaaaatacaaaattagccgggcgtggtggtgcatgcttgtaatcccagttactccggagkctgaggcaggagaatcacatgaacccaggaggcggaggttgtggtgagccaagatcacgccattgcactccagcctgggcaacaagagcgaaactccatctcaaaaacaaaaagaaagaaagaaaaaagaaagaatatgataaaaaaactaaatagggaaaaatcttaggaaaacgaatgcatgtcaagtatgaaaagacagayggtaaatatgtattaaacataaagagctgattcacatgcttaggtaaaagaaacctgtggggatgtataagcagtgaatatgaatagataataacccaagaagaacaatgtatgacagacaattacagtgaaatctctctcttacattaataataaaaaataaaaatgaaaaccacttttaggtattatttaactcttatcaaaatctaaatgattctaaaataagctttattattcaatggtagtgaattttgcttgaaactgccatattcayatataagtctggaatatttataaatttatgttatctttttaaagatcactaagacagtagagcccaagaagttcaaaatagttttcctttcactttttagtttcacatatgrtgaattatsctaaagaaacattttaaaagaagaaagctaaattatgaaaataatggccggggcagtggctcacatctgtaatcccagcactttgggaggccaaggagggtggatcacctgaggtcaggagtttgagaccagctggatgaacgcggtgaaaaatacaaaaatgagctgggcatggtggcaaacgcctataatcccgctactcgggaagctgaggcaggagaatcacgtgaacccaggaggcagaggtttcagtcagctgagatcacaccattacactccagcctgggtgacaaagcaagactcaatctcaaaaaaaaaaaaaaaaaggaaatatttataacatcattatttatatcagtgaagcattgccccctgggaaaaggaaaaaaagtttaaaagaaaaaattatattttagaaaaatggctgtattttttatttagaaaaatggctgtataaataagattttatatatatataaaatatatataaaataagattttatatatatataaaatatatataaaataagattttatatatatataaaatatatataaaataagattttatatatatataaaatatatataaaataagattttatatatatataaaatatatataaaataagattttatatatatataaaatatatataaaataatatataaaataagatttcatatatataaaatatataaaatatatataaaatatgattttttatatataaaaatatatataaaataagattttatatataaaatatataaaatatatataaaataagattttatatatataaaatatgattttatatatataaaatatatataaaatatatataaaataagattttatatatataaaatatatataaaaatatataaaataagattttatatatatatgaaatgtaaataagattttatatatatatgaaatgtaaataagattttatatatttgaaatataaataaaataagattatatctaaatatatataaaataagattttacatatatgaaatatatataaaataaggttttacgtatatatgaaatatatgtaaaataaggttttacgtatatatgaaatatatgtaaaataaggttttgcgtatatatgaaatatatgtaaaataaggttttgcgtatatatgaaatatatgtaaaataaggttttatatatataagcaartctttgctacataataattcaacacatatatatatgttgttttatatatatatatatatatatatatatatgtrtgtgtgttgaattattakgtagcaaacacttggaaccaacccaaatgtccctcagtgatagactgggtaaagaaaatgtggcatatatacaccatggactactatgcagccataaaaaagatgagttgatgtcctttgcagggacatggatgaagctggaaaccatcattctcagcaaactaacagaggaacagaaaaagaaacactgcatgttctcactcataagtgacagttgaacagtgagagcacgtggacacagggaggggagcatcacacaccggggcctgtcagtaggtgggaggcaaggggaggcatagcattaggacaaactcctaatgcatgtgggacttaaaacctagatgatgggctgatgggtgcagcaaaccaccatggcatatgtataccaatgtagcaaacctgcacgttctgcacgtgtatcccagaacctaaagaataataaaaaaaatttcaagtttgaaaaattcgtttgaaatattaaaataatgaggtgattttaaggaaaaygcgtaataccaaatgatacgtgcatgatgatatgaactatgttacaggtatacatacatccaaagactcgagtttcatttaaaaaattaagggtttttttcctttattagggtgatgagatgacagaratttcatcctaacatatctataatattattaaaatgttttataataaaaacaaaaaagtaaggtatatggttcccaacaaattaaccttgaaattctttcattatgaatttcctgtaaacttttcatccacttgataaaatgctgatattacagaaacgtgtttcacttctcatgagcacgtgcttttaatagattacacaaactccaaggatttyacaatcgtttatcagcacaytgacatttaataggaagagtaactttatgtgaagctactttttgtcctaactktggaactgatattaaaaggcacacttgaacagtgtgagttgttcactgcctgctaatgaaggctcatgcaagtatgtatgttcacgttactaaaaaattrcaatgattataaccagagtaagcagctgaaataatctggtaattttaataataaatgcttttgaagcaaagtgggttcactgagggtaatattttttgtttcagtttgctagttacgtgcagtgcagagagaaatattttattttccaatatgtaacagaagaatttttaaaatccctactttagtgaaccacaaagttttcttgaggcataacctaagatataaaatccagtcatcttgaaaaatatcttgcctttcatttatttatgtaattttaaatacggcattatgtatgtaatgagcaccttcaggaactctctgatccctgaaccaaagagatcaaaagtccacatcatggatctggcttggatgagagaagacagatgatagacaagacaaataaggaatatatgtttttgggggaaagaaaatgaagccagggtggggaagacaaagccccaaggggttgtaggttgaaaatggatgttcaggaacagtcagcttgcttgcttgcttgctttttctttctttccyttttttttttttttttttttttttggagacagagttttattcttgttgcccaggctagagtgcagtggcctgatcttggctcactgctacctctgtttcccaggttcaagcaattctcctgtctcagccttctgagtagctgggattagaggtacccgccaccacactcagctaattttttgtatttttagtagagacagggtttcatcattgggccaggatggtctcgaactcctgacctcaggtgatccacccgcctcagcctcccaaagtgcaggaattacaggtggtctgcttttttgagtcagactttaatgacggcctgagtgagacgagaaggcattcaggggctttgagcatgggagtgactcaatctgccttactttttaagaggattcttctgggaagtgtgtggagaattaattcaagaatgtaagcgtgaaagtcagggagctattaaaatcaacaaggtgaggccatgctcaatagctcatgtgtgtaatgccaaaaatttgggaggctgaggtgggtagattgcttgaggctaaagagtttgagatcagcctgggcaacatagtaagactgcatctctagatgggcatggtggcatgcacccgtagacccagctactcaggaggctgaggtggaagaatcacttgaacccrggaggtcaaggttgcagtgatgtgatcacacggctgcactccagcctgagcaagagagcaagaccttgtctcaaaaaaaaaaaaaagaaatgtcacggtgaaagggatgatggggcttggacaggatgctagcaaggaagtgacaagaagccctcagtttctacatagygtttgaaaacaaagcaacaggrttggatgagagattggatgtagtggatgagaaaaggcgaggaaaagaagacctctaggtttgcaccatattagaattctaagcaggggtgttgttasgcagtgcatatatgggtytgtagttgagagaygagctatgggcaagagataaagacttaagagtcatcagccttctagattatatttaaagcaatgaggctagtgagatcaccaagggagtgaaaataggagagaaaacagaacagaaactggaccctggctcactctgctgttgagacgttggggagatgaggaggaatacccagaaataaataaaactcccctggatgtgctatctcagtgcaatcatcagtatctctcttctcaacaaaaaaccrtgagcatgaacaactttcatttatgcactcagggactttcatttttatacatttattactgccaatcttgcaaggttttatttctgcttctaccacacaggaaaaacaacttaaattctatgtggcaggttatggatttcttgcaggccacgaacttctttgttcttttccatgaccctgactgcttcttgtttttctcttgcagcgtcaaaaagttcttccttgtcttttgtgctgagtcttcttcctctactcacccactgaatatcatgtttttcaagtttatgtgtgtggtgtttttttttttttttcctgaaaaaaggtatcttctactgtttgactttttccctacgattctttgttaaaatgctgtgttttagatgctattaatttgtcctctctcttaatgcccttggattttcctcttaattgtctgcaccattgctgttacccaagatgcctggctggagtagataaaaataagccgaagtccaaaaattggaatagaatggaaggaatggatcaaaggaaatcaggagtttttgtgcagtcagatatgggtcttatagatgagagcggtctaraaaagcagttctgggctcarattgcgtgactgtgctttgccggcatattcctaactatatcacatattctccactatacagtaagtagatgataataataagtgggtatgataataaatagatgatgtaaatggatgatataaccacagtgaaaatcctggaaaaagaaaagttaggttgctrtagaaaatccacgtttgtagctagttgtgttatgtaaaacaaaagctgatgctgagattgagatctggtttggctatattggcttgatcaggacacaggcagtagttcaagccatggaagtagatgagattctcagagagactgtgcagactaagaaaaaagaaagtaacatcagaaaatgccacaaatcctatggcttcattatctctgatgaatgtgakctttttttttttctggaaaatatacataccaacatttcgtgcagttcatgataaaccaatcccttttgaacattgcccagaaagcaaacagacttcccatggtgcacaaatgtagccatagggaatattgttcattcctcattgcactgagtatgcttcagtgttcacctsccttctggcccactacacctgtcaggggtattttatagactaaatagtgtcagttagtctaaatcactcatagacatgtactaggtggttttcctttttcagagattaaataaatcttcccaaggtaaccacggtttaaaatatagtaatccacaaaatatttattatcacttctatatgctaaaaaaaaataaatcaaaggttagaaacttaaagaaaaaacaaaatcaagcttcatctctagttcaaagtgaaagggagaaaagcaaaatgtttcataaacaatatatattgtctcactaataatattaatccaggtcactactgccaaagcaaacaataaatttttacttcatttgtatagatagtaattcaatgttatattttgggtaggttgtgaaagccagatcaatttatgcgatcagaaaaataaaggaagaaattgatgagtcggatgctaccggctacatgcctctccagcctcttctttttgaacctcctttgtacctgtttagagaaaaagcataaatagtgtactaccaacctaactaaggttrttatagtctgtttgtttaaaataccatttttttctccttttgtctttttcccactctcgaaggtactcaagaaaattgaacagatgtaatagatsaaattaaaacattttatttcctgaaagccttttttgcctgttgtaatgtgcaggacccctctcctttaatgggagagacaggaagttacstgaatctaggctgaaaaggttatgtgaaaagaaagtataataataaaagggacacttggctttwtaaatctttgttttctcttaacctaagtaaggcatattaaaaataaatgttaaggtgaaaaataaatgttgtctttatgaaaaattaaaactgctctcagttccatattgttcataccttcatgctttttaacatgatattwtccatcctggaatgaccttaccccagattctgctcattttcaaaaccctgattcattgtcatcwtttctgtattcctaccttgattacccacttccccaaaagagttaatcactcacttttgtactatgcctgtgccatatatatatatataattatatattatataataatataaatatatttaatattatatattgccaattctatgatatataaaatatataatatataatatatttgccaactaatataatatataatatattaacataatataaattacatataattatacatatatttatattatatattatataattgscaaatatatatggtattacatataatataattgggaaatatatatttataatatatgttatattaatatrataatatatttattatattatatattatatatattatatatttgcctattatataatatattatgtaatatattaacataatataaattatatattatataatgtatatataaatatgtattacatgttatagatgtaattatataatgaatatttatatctatatagttattcatctattcatrtatgaatattcagcatattctatttattcagtatattcaatatttatttaatatattcaatgttccaggttgctttaggctstagtgacataatgtggacaaaagcagacatggtccctastcgttcagagttcagagtgtaaagatgtttatcagattcaaaagtcttcagcttttttcacaaacggtcttacctggtagatagaataatctgagctgtttattttgcatttcagtaaaaatggaggcagaatatctcaaatgtgaggatcaaagccataatcaaacatgtggagaaggggccagtaggtagcctgaaaggaaagcttttctggttatagacatrcactacataataatgtttcagtcaacacaggaccatatgtatgatggtggtcccataagattataatggagctgaaaaattctatcacctattgacctcatagctgttctaagggaataggaaattgcattactcacatatttgtggtgatgctggtgtaaacaagcctactgctctgccagtcatttaaaagtatagcacatacagttacgtaagtatttaatacttgataataaatgttaatggtttatgtatttaccatattatacttcttaatcattattttggtgtgtactcctcctatttataaaaaaagattcaaccataaagcagcctcaggtatgtcctttaggaggtattctggaagaaggcaatgttatcataggagatgacagctccatgcctgttattgtttctgaagatctttcagtgggagaagatatggaggggaagacagtggcattgatgagcctgaccctgtgtaggcctaggctaatgtgtgtgtttgtgccttagttatcaacaaaaaagttaaagaagtagaaacattaaaaaaaaaagttaaaatagcttataggataaagctgtttagaaagaaattatttttgtacagctacacaatttatggtttaagccaggtgttattataaaagagtaaaaatgttgtttaaaaaggtttctaaagtattaaaggtactgtaaactarggctaatttattattgaacaaataaaattttttatacattcagtgtagcttaagtgtgcaatgtttataaagtctacagtgtttcacattcactcacygctcactcactgactcacccagagcaacttccagtcctgcaagtttcatttatccaattgccctgtayaggtgcagaacttcgtatcttttataccatatttttactgcatttctctatgtgtagatatgttagaaacacacatacttgccattgtgttccaactgcctacaggattcagcacagtataacatgctatataggtgtgaatcctaggagcaataggctagaccacacagcctggggtgggtttgttgcctagcagcagtaggctagaccatctaggtttgtgtaaatgcactctatgatgttcacacagccrtgaaattgactagcaatgcatttctcagaacgtatctttgtccttaattgacacatgtctatacataccaggtatacttgaacacaatttttgcgaatccatcttttacaaactgagttcaaagttaaaaagcattagtacatagttccaattgccttaaactatagggttttcgtttttcttttttttttttaaattatactttaagttctgggatacatgtgcaaaatgtgcaggtttgttacataggtatacacatgccatggtggtttggtgcacccatcaacccatcatttacattaggtatttctcttaatgctatccctccccttgcctcccaccccctgacaggccctagtgtgtgatgttcccctccctgggtccatgtgttctcattgttcagctcccacttatacgtgagatcatgtgatgttttgttttccgttcctgtgttagtttgcggagaattatggtttccagcttcatccatgtccctgcaaaggacatgaactcactcttttttatggctgcatagtattccatggtgtatatgtgccacattttctttatccaatctatcattgatgggcatttggattggttccaagaatggcgatcattaaaattcaagaaacaacagatgctggagaggatatggagaaataggaatgcttttacactgttggtggggtgtaaattagttcaaccattgtggaagacagtgtggcagttcctcaaggatttagaaccagaaatgccatttgacccagcaatcacattactgcgtatattcccaaaggattatgaattattcaactatattttaaagtgaattttgctaagttttattgtcatgtcagttttttttaattatttggtttttttgttcatttgttttgcttggtgagtaaaactgctctttaaatctaataaagggaggaaatagagaagagtgtggatctaaataatccagtttggcttcttacaatagttcattttcccagataattgtttatttattttgctttgcctctacctgagaaaggagaagatttgggttctatgcctacctcccttcattcccttyctccacagtggtcagatccattaaagaacagagtccttggtcagatcaacatagsattcatgamaaccaactctcagaaaggaggaatatgcaacgactgtcactgcaaacttccaaataaagaatcttcttagtgatattttcaaaatatattgacaggagttgagtcatatccttgcatgtcactgcctctccccacagtgggatgaacatttgcatctgaatgatcgcccttcatttcctgagctggatttgactttgctgtcctaaagatgccagtgcactcagttagaactgtgctgtgctaagtccattacacagcattcaagaaaataagaaatgatcagaagatgttggctttatgctaaatttgtcaatcacatgaacggaactgtgtccaacaaaagaagtcataatcaccttttatggaaaaggttcttaaaatgtggtcctcagaccaattgcatcacctcttgagaatttgttggaattgcaaattcttgagcccccaccccaaatatcagaaactctggtggtgaggcccatcagtttctttttatcaaacctttccaatgtttytgatacatgttaaagagacacaggaacatttttaaaagctgcttagtatgcacataaaatagagattatgctggaaaaggtacaaggacatatttatatggctgccaatgtaaaatgagaaaagctctggaaagtgaaagagtgaatgagagaagagagaagggagagagagagaaagaagggagagagaggagagagggagaaggggagagagagagagacagacagagagaaagagagagaccgggtacaatggctcacacctgcaatcacagcactttgggaggcagacttgaggtcaggagttcaagatcagcctggacaacatggtagcagtgagctgagattgcaccactgcactccagcctgggaaacagagtcagtgagactcygtctcaaaataagtaaataaataaataaatacttttttttttttttttttttttttgagacacagggtttcactcttcttgcccgggctagagttcagcggtgcaatgtcggctcactgcaagttctgtcttccgggtacaagcgattttactgcctcagcctcccgaatagctgggattacaggtgctgccaccatacctggctaattgttttgtatttttagtagagctgtgtttcaccatgttggccaggctggtctcgaaatcctgacctcaggtgattcacccatctcagcctcccaaagtgctgggattacaggcgtgagccactgtgcccggccaataaataattttcttaaaagatccaggaaatatttatttagtccaaatatgcaaaactatttgtcctaagggaaattattgttttttcagcaaatagagtaattaaaataatactaaggaaattccttatttggcagttcgcaatgacaatttgtatgtgcatcatttctgagaactgttttttctgaatcctatgttgatatggacaaggactatgttctctaatggatttaaacattgtggaggaagaggatggaggaaggcaggcatagttcccaaatcctctcttttgtcagatagaggcaaattaaaacaattatctgggaaaattgacttttgtaagaagtcaaatcagatcattcagatccagacatttctttatttccttccttttactctattaaattactgattaaatcattttacaagttattttctgtcacctgtaaaaaacttttcagctaagaaagaagagatacctctttttccacactcaaaaaacacacctctaaaaatagacatacatgtttgtaaatagaaagatacatgagagggttccacatacatctgtctttttacgtgaaagttaaaacttatgggtaagtttaatacattgctgtatatgagagatatacaaatttaactaattatggtttttttgctaaaattaaatgttatttattacagattgtgtcatagaatatagattccgtttcatttttttttaaatgctcatcatcactggccatcagagaaatgctaatccaaaccacaatgagataccatctcacaccagttagaatggtgatcattaaaaagtcaggaaacaacagctgctggagaggrtgtggagaaataggaacacttttacactgttggtgggactgtaaactagttcaacccttgtggaagtcagtgtgkcaattcctcagggatttagaactagaaataccgtttgacccagccatcccattactgggtatatacccaaaggattataaatyatgctggtataaagacacatgcacacatatgtttattgcggcggcactattcacaatagcaaagacttggaaccaacccaaatgtccaacgatagcctggattaagaaaatgtggcacatgtacaccrtggagtactatgcagccacaaaaaaggatgagtttatgtcctttgtagggacatggatgaagctggraaccatcattctcagcaaactatcgcaaggacaaaaacccaaacaccgcatgttctcactcataggtggaaattgaacaatgagaacacatggtcacaggaaggggaacgtcacacactggggcctgttgtggggtagggggaggggggagggatagctattaggagatatacctagtgttagatgacgagtttgtgggtgcagcacaccaacatggtacatgtataatatatgacagacctgcacgttgtgcacatgtaccctagagcttaaagtataattaaaaaaaaaaaagaaaaactgaatagattccatttcaaactgaaatttcagtttaaaacattatgcaaaagagccctagccatttcatgtggaattaatatatttttccattttgtttcatagaagtatggagcagtgggatcactttcacaatcaacaggaggacactgatagctgctccgaatctgtgaaatttgatgctcgctcaatgacagctttgcttcctccgagtaagtagagggggatgggctgcccatggaggttgttcttagagttattgacaaaatataaaattatagtcttgagacttaccttaaatgtawgtggatgttaaaataatacttatttgaccaacaggggtattcttgagacagaataaaaataagcttaaataaaagtaaggcagtattatatgaaattaaattaatctacaacattgattgagccttctggcttcccagctacaatattaggttctggagataaatatgatcctagcaccgtgagctaatattcgaaaatcatgggtggtaggtgcctgtattagttttctagagttgttgtaacaaatgggaggcttaaaacagaaatgtattcgctcacagttctgagatgcagaagtctraaatgcaggtgtcagaaagaccatgtgccctttmgaaggctctagagaagaatcttcctgtgcctcctcccagcttctacgggctmctggcagtccttagtgttccttgcctctgtagctgcaccactcatctttcccgccttcttygtatggtcttctctstgtagctatttgttcttttcttacaaagacatcagtcattagattagggttcaccctaatccaatatcacttcattttaacttgattacatctccaaagaccctatttccaaataaacttactttcactggtacctatggttaaaactttaacatatctgttggtggcacagaattcaacccatatagcagtggtgaaacatgtttgcacaggttacgacaacagctaaaaagtagcaatactcagctgtatctcaacaggatcatttaagatgtcaggagaaagttacttataattctgctaaacctcaaaatataaatacatatcgctaaggggatgggtggaggcagaaaagaaagagaagatatttcagtgtgaagaagcagcatatacaaagttaaagcctcatatatgagttcttacatagcaaacctgaaatacagacctcaactccagggcacagtggatcttgtgctctgtgtaaaggatggatgggaggatatggcacaagtgagacacatgtaagaaaagataacagtgagggctgttacagacagaaatgatgagagtttgaagaaggaggagagagacatcgggagcagagaaaaagcaatcaaaatgtttgagagctattyaaaaggtagaatttacatttgtgatgataaattagagatgagaagatgactcctacttttcaggcttaatcaacctggcaggtggactatatctccacttgcttctattatgggttctttttcttttttccttccatcttttctttcctttccttttctctcttttcctttttttttttttctttttgagacagggtctcactttttcacctaggctggagtgcagtggtgcgatcatagcccattgcagcctcaacctcttgggctcaagcaattctcctacctcagyctcgtaagtatcttgggttacagggacatgctaccatgactggctaatttttgtagtttttgtagagccakggtttctccatgttgcccaggctggtctcaaactcctaggctcaagccatcctcccgccttggcctcccaaagtgctgggattacaggcgtgagccactgcatccagctcttctcttttctttactttttaaaaactgtctcttattttcttttcaataccttaaaataaaaaagtttgtttttaatttaacaatttgcaacctgaaagcaacatttactttttttaattgatcaatgaaagcaatgaccatagaaaataaatttttaatgaccattgtattcaactaatcagagaaatgacttcctcatctactgtttcccctttatattgatttgtctctactacaattaatatcccattatataaatcacagtgccatataaatgcatatgaataaaaggttactgttattaatatgttctgaaatatagagagagtgggcttcattgatccattctaaagattagtaaaaatgtgaatcactttatttcatttttcttaaatattgtttacactgtattcaaatcataagaggtatgcagatacaaaactattgagaaggaattgaacaagaaaattattttaacatcatagtcattgaaaataagtatttgccctatctgattttaaaatattaaaaaattgcatagttactttagaaaattttattgtcacccagaatattttcccatatgaacattgaataaaatttatgtttgtatatgtaagtgttgatattaaaatttaccagctgattccaaaagatcaaacaagcacaacttgtagagcacagtaactttcttgtagatgtttagtgagtggataagtcagtcaagtgcctataatgatacctggattggcttttcctgtgactgtccttttgctttctactgcaaagatgtggaacatkttttcttcttttttattccaataggcttggtagtaagaatataattggagattaaaacaattttaattatggaagaagacaacactttctaacagtaggctgggcttttttgttttattagatcctaaaaacagcccttcccttcaagagaarctgaagtccttcaaagctgcactgattgccctttacctcctcgtgtttgcagttctcatccctctcattggaatagtggcaggtaacgtaacccagagttttgaaatttagtaactcgtcccgtgaattattcattgccaaagcaaaaaagaagcattcagtcttttgtatatggtacattcataaagaaaatactgcattacaaagtgtccttcaaatttgttaagttaaaaaacagattccgcaaagttaagtagaaaaaaatagtttttaaattagaaaaaacaaaatagaatggaaaaaaagaagtgcaagataaaaatacagatttgtaatagtaaaatgaaaaggacrctctttcaaaaatatattatcctctagagtcctctccttctaatgtgggtgacaaattttaaaagtattcattttgccaatgtgaagaagtaagatgatcatttacattaacaatagctataatataaaaaaaaagcctgttgtccaggagaagctcttctattcttagtactgagagcagaaaaaatatttctgtcagtttttaaagagaggagactttgtagaataatggcctacaacttagtaaaatccagcttatatgaccacatttttcatagggatattatttaaaatatctctaaaaataacctgatagtatcttctcaaagaaaaaatatacaacgtgatacttgggctcaaaatgatgttcctgaggtatatatttctttggagggtctgacttgaaccggagatagatttgactgtttctacaagggtagatagcttgtatacaccgtaagcacttatgtaaatattattccccgcgtagcattttggatggatttgatgtatttcgattggcatttgaatttatatgccttatagctctcctcttctctatatgactgataaaatgtctgcccatgtgctctaataagagataggctgggaataagatacatttttatgtgcatactaagcagtttaacaacaacaacaaaaaagttcctaaagaccaggccaaagttcctctgctacagggcagtctaaggaagtattccaagacagagcaaaaattccactaagaaagaaataatgaaaacaataatacacccttacaattaacctctctacagagactgtaattattctcattatccacataagaaaattcagacagctcagtattggagctggagttcccatccaagacttccgaaccckagttactctggtctcttgtctcccagtttaatcaagtctttataaaacaacatggttggccaataaaaaaacaaaaaagtcagctgggcacggtggctcatgcctgtaatcccagcactttgggaggccgaggcgggcagatcacgaggtcaggagatcgagaccatcctggctaacatggtgaaaacccgtctctactaaaaatacaaaaaaattagccaggagtggtggcgggtgcctgtagtcccagctactcgggaggctgagccaggagaatggcgtgaacccaggaggtggaacttgcagtgagccgagatcgcgccactgtgctccagcctgaggggacagagcgagactccgtctcaaaaaaaaaagaaaaaacaaaaaagtcaccacaggaaaatattttccagaggtaacaattaacttctttttggccattaaaaatacactaaaacaaaaatccaaccataacaaccaaccaaccaaactattgttgtctgagtaaaaggacctgacacgtttggcattaaacaatttcctggtaaatcaaggttatctgtatgtttgtttatgtctatgcttatctgtaatttgaaatgtataactaaatgatgcttcattgttgggattattacatataaaccaattagaatttgagtagatttcatcacctttatrcaaatcactgcctgcagtaccagcaccagggaccgcagcttctgataggctcgtgcagagtgcagacaggagtcggaaaataattcaaggttctaaccaagttcaaagtccccgagctattagaaaatactaccaagtcaacacatttattctggagtttacaatgattgatttgaagtagtttgtttactgaaactacagtaggtaccgactaaaattgactagacactaagaatgttcaaattttataagtacacatcagtatcagattcaccagaatttggaaaaggcctcactatgtttattatgtattaacaataaacaattcacaatccacttacaactttaattaagttgtagatcagtatatttttcaaaaagaaactaaaaagcaatatatatctctacttggcataaaaaattacaaatgtagacagaatatatccctaaaatggtagaagtttggcaaatatgaattcatgggtgaaatagaatattatatataaaactctgtgaagtgaattatatattgaggggtattttcttaattataaggtttattccatttacaatcttttcttaaagaagctgctgaaatactgtcagagtgtaacaacataatactgtgtcagaacaataagataaaaatcaagaatttatgtatatatatataaattgttactgaaatactaaaaattctttagctgaaaacaatatccatttggggtatgaaaagataattccaatatgaaagagtagatatgatctgtagaatcaaatataaccctgtccgtaggttgttgcacagaccataaaattctgtctcctttcatatgtgaaacagaaaagtcacaaaatgccatctctccaataaaaataagtgaacttttgaaaatataaatcctggcattctttacctagatatatgataaaaagttaacattttatagaaaaattagttttcactcagggttcgatgaaacaggcaatttgtgtttttagatctattaacaaaatgtagcatttactgtcacctcatgtttaacttgttgtcaaattaaaaatagttggtcatatgaccttagtcacattggggcttctctttccatattgtgaaaaatattagctttactgatacaaaataaatcttatttccagtgaaagtaaaagtatatggttgagcaatcagagcaatgtgcatagtaaaataaagcagagagatgactgtgttcatatgaacatccaactccagaaaaagatttttatcacacaatgctacttccccatagttaatcaatattgggcatataggtacctgaatcacacatcttgaatccaaatattaatcatagcaaaaacctgaaamttttcaagtgcttattacatgccaggaagtggtctaagtattttacatatagttcatttaattatttggacactgactattagtaccccatttatacaggtggtgaaatagaggcaataacagattaagtaacttgtccaacgccatagtttataaagggcagagccagaattgctaacccaggcagttctattctagaatctaaattcttaactgctacttcaaaagaaataataatcaaaaaaggacaacgttagaggaaaattttgaagtaattttgataaaattgtttatttgggctcctcattgttacagtcaaattccattcccaattgttcttttattcccagagtaactcaagcaatactttccacatagtatataagaattaaatcatrgaattaatgaatgcatggatgaggctgtcaacccaaaacttggtccccacaatgaatttaataaatgtgatgagatacagttaagaaatatacttttatttccaaggtattgatacgttaagacatgtagagtaacatactcaatacaaactctattgtagatcacatcaaaatattgtcatattttgttatttcacataagctaatattaaattaataaaacaaggaaaaatatggtatcatgtattttttgaaattagaatttaactgcatatttaggatgacactcttaatgtaataatagctacagtagtaatgcttatcaaacagcttctttttttttttttttttttttgagacwgagtcttgctctgtcagccaggctggagtgcagtgcagtggcacaatctcggcacactgcaacctccgcctcccgggctcaagcaattctcctgcctcagcctcccgagcagctgggactgcaggcacccaccaccacrcctggctaatttttgtattcttagtagagacggggtttcaccatgtttgccaggctggtctcgaactcctgacctcaggtgatccacacacagcctctttaagtaaaggtagtaaatacggtggactctgtaactgagataatgtctctcatgtacaaggcactttagaggaatagatatgcctatttaattagtgttcagcaccactgttgaggtaattgttacttttacaaattgagaaaaccaaagcaaggagagcgataagtaacttgttcagagtagcctagttggtaatggaggagtgtaggaagattctagaatcagggaactagatcctatgtaaacaccaagctgttagttattgaacaaaatccttgagttaggggtagaactaaatgtttttcatgtgttgtttaattctcaaaaatctataaaaatggtactatcaccatatcacttttattagaaaattgatagactcaggtggagctgcatatatttttgagcaatatgaaattattctttttattgttccataattgtcaaatgcggaaaatcttatacaaccaatctaatatgaatatgactaacatacatgtagataaaaggtataaatagatacatatagagagatataggaaaacagaaaacctcagccatgactgaatagtgataagattgtgtttaacattttcctcattstctataattattcatgttttgtttttttttttttgagatggaatctcactctgttgcccaggctggagtgcagtggcgtgatctcggctcactgcaacctctgcctcccaggttcaagtgattctcctgcctcagcctcctgagtagatgggcctgcaggcgcccgccaccacgcctggctaatttttgtatttttagcagagacggggtttcatcatgttggccaggatggtcttgatctcctgacctggggatccacctccctgcgcctcccaaagtgctgggattacaggcatgagccaacgcacccggcctatttttgcataaaaagttaatgtttaagccttttatttttttgaaactagaaaacatattgctttagattatttcagaatgataattagattgtttagagaacatatgcccatttggggatatctatcagcagctcagtatgttcctaaaatactattttagaatataatttttttttaatttgggaaataattaatcacaagattgttcatcaaaacattggctatattactgaaaacagaggcaaactaaatgcagctattttttaaataaatctggcagatccatacatatactacaatggagtttttaaaattatttttgtagaataatattaaataatataaaaaagtacttatgatagagcattacattaaaaakttgtttccagattgtttaaaaatgtcatattttaagataataatatgataagggttgagacacgtacaccaaaatcctagagtttaagctaggatggtgagattcatggtaaattgtttttccatattatgtatattttctaaattttctgctgtgaatatatattttataatagttaaaaaggagtcttatgagaatcgtacctttataaagtgaaaaaatgtatttgcccaatttcctgctccaccaactgtgaattaggtctgtattaactgaaaatgacgcttttctggcagctcaagtgaaagaatgaagaagataaaccaacaatttatccatattatgcatgacaccactatttcaccacttattgcttttgtcatcatcatgattatcactgccattgttaacatattcaacatgcttacttcagaaactgtattaagcattagtccactttattctaacagcagttctgtagacacatagcctttcataatctatagaatttttttttaattggcaaggccaaaatcaatggccaagaagattcatataagcagcaattcagaaagcatgatataatcctggaatcatcttaacgtaaaataggaaagggagaatgtatgcttctcagcaatatacgtagcgtagttcacacgttgtagattaaaaaaaaatactcgatttagcctagcattcaaaatgttggaatggaatggaataaaatgaacggaatggaatgatatgggatgggatcctgtatgcattcaaggatcaggccatgactggtttatttttacttaaatatacagctcaactcctgaagtgggaaacgaagaattgctcagttagttcaactaatgcaaatgatataactcaaagtctcacgggaaaaggaaatgacagcgaagaggaaatgagatttcaagaagtctttatggaacacatgagcaacatggagaagagaatccagcatattttagacatggaagccaacctcatggacacagagcatttccaaaatttcagcatgacaactgatcaaagatttaatgacattcttctgcagctaagtaccttgttttcctcagtccagggacatgggaatgcaatagatgaaatctccaagtccttaataagtttgaataccacattgcttgatttgcagctcaacatagaaaatctgaatggcaaaatccaagagaataccttcaaacaacaagaggtaagagtttgtggactgcaaggtcacttgctggaactgaatccatccaagtctcgtctccttaggcagtacaggaaagcaaaagttgcaaaccctgtttcatcatcctgtttaccctgatttctatggctaacttatccagattttaaacgaatgttaagggatttaaaatggattcgccttctctaaactcttagaaaaaggggaaatttttcccattgaatatagactccctttacatattttataaatactgttaaaatgtctttttagactgcctaaaccaatcataatttttaggttatcttagcagatcttgagaagtgaacactctgtatgtgtgaattttgcaacagacatatttgatatgcttagatttttttttttatttgtaagtttcactcagaacttttgaacttatacatggtcctcaccttaaggtgtcagaagacaatggtattacagtttttgtatggggagtctgttggtgaacctcatcccaacatgttgatattccgtttctattccatgtcacgtctaaaatctatcagtgtttcctacattgttaataagtaagcatatcaaagggtattgggatatcaaagccttgggctatagaaagattagagaaagtgtacaaagaagaaactgtccatagttttgaataatataagaaagacagaaagcgaaaatgttagttatcaggatagacattgattaagttgaggggaaagaagaatggagaagaaatactatttatgtagaaatagggtcagaagagcactgagatgaggtaaggacagagggaaggtggatgagatggaagaagaaggatacatttgattctggcagtgcattaaatcctgcagagaccatggaatgtttttgtttgtttgtttgtttgtttgtttttgagatggagtctcactctgttgcccaggctggagtgcaatggtgagatcatggctcactgcaacctctgcctcccaggttcaagtgattctcgtgccttagcctcccatgtagctgggatcaaaggtacgtgctacctcacccggctaatttctgtatttttagtggagacagagtttgcaccatgttggccaggctgatctcgaactcctggcctcaggtgatctgcccgtcttggcctcccaaggtgctgggattacaggcatgaaccactgcgcctggctgaccatsgaatgcttttgaacccaaacatgaggaattgaaagcaaattggaaactatctggaaggtggtagaaattttgaacctgtttgaagtgataattaatggaaacgatcaaaatctggtgatcagtgagctgtttgagtttcgatagattacacttaaattttggagggaattccagcattagaaaaggaaatgcaagggaatggtgaaagtttgaaagctatatacatctttaaaaacagtagtcactcacagagacttagaaactaggtcagtgccagtgcgtgcatgtgtgtgtgtgtgtgtgtgtgtgtgtgtgtactcctgtgtacactgaaaaacaacattgggacgctcatccccattgcttgaataattttattgacctttgaatctttagctcaatgtaggaataaataaattaaatgaatgcctgaatttgtaaatggcgtttgaggaaataggttataagtgacaccagcataacacttatcaaggacacaccaaaaattaatttgaaagaaagaggaagaacattggcascaaatgaaagacaggggtggcatttatcatcatccatagaggtgaaaaggactgtacgactacaaaattaaatgcctgtttctaggagggtcactggtggtagcatgtggagggagtgtgtggatgctatataggrttttttgaaattaaatacacttttcctcctcccagtgaaaataatttccactgaaatttgacaaatgtaaacaccatgtgcagttttcaaagaagggaataataaggcagcctcagctgccaggcgcagtgcctcacacctgtaatcccagcactttgggaggccgaggtgggtggaccacgaggtcaggagttcgagaccagtctggccaacatagtgaaaccccatctctacaaaattaaaaaaaaaaaaattagtcaggtgtggtagtgtgcacctgtaatcccagctactcgggagaaccacttgaacccaggaggtggaggttgcagggagccgagatcatgccattgcactccagcctgggtgacagtgcgagactccgtctcaaaaaaaaaaaaaaaaaaaaargrargaaaargtagcctcagcttttaggtatgatgaaaaacctggatgattcctcrtttctaggaagcaaaatcactgtctagtcacttaacactttatgctgaatgtctggaactacccgacatacttgcagcaatttttagccccctaaattaagtcaagtgtatttatcatggcggtgtgccctacaaacatccatgctcactatttcacctttattgtaatgatggtattgtacagaaaatattaaatggtcaggggaggaggaggtgcaagatagagaaattctaatctagaataaggttttgtttgggagaaggcacagttagagcaataaaagctggtaagtctctctgcttcagtatagtgtcattgaagaggcaaatctasacgcacattcatttattttcgaaggtcctacactctgaccatcttgatcctctcacctaagcttgtctagtctagtccagctcaagagagtgtaatattctttttacttctggattaaagaaaaacataccactggcttatttccccatgtgcaaatcggaaatgagtatctatcaactttagaacataggagtacttaatacaataataaagcatacaatgaagacagaaaatgggataaaagtagaacagagagacaaaaattattaccagaatagatgagaacatttggttcatcaaaaataaaaagcccaatgctgaaagagaaaaccaagcaaatgatctaaaagaaaaattaataaayattaatcgtcagaaatttaatgactggatactttaacctcactataatttgaaaaacaagttaagtaataatgatttgctatgtacctactcttactatgcaaacttaaatatattaatggtacccagtattcagctgcaaaaagtggacgctgatacgcagtaagaggaagaaaaatggtagcatatatttggagagtagtacggcaatggttgaacaaaaatgctgtttaatgtttagtccctttggtcaaatccacttcaggaagatgttctatagaagtacttatatcaatatacaaatatatttaaaatgatgttcatggcagcattgtttagttgtagaaaagtgcacagctcaaaacactatgaataggaatcctaaataaattttgagaaatagattcaattccactaaattactgaaaatatcagtctctaaagtattttaatagataaatatccttaatatattattgagtaaaatataaaagcatattccaggatataggtagatcctctgtctttttcacactcttaagtatatgaatgtgtatgtataaatatacacaaaatatacgtgtatttgaaaacacaaaatactaatgcctcaaatacagaggcaatgcaaactgaaagtaaagcactgttaatatgcgagttcgaggttttattgagtatgaaaatctattgtcaatgatcatcaccactgaggattatgacattaaacttcacttattactataaaacaatttccaatataaatctatcaaattcacgaaatttgactatgttgccactgtaagtacagtacgaagacattttacttcagataaattaagaccttatggtgtttatttaattttattgttagmattttgacatctatatatataggaatagaaacatatcatagatacattaaattgatttttgaagggggttgtgattgtaaacattcagccattcagtcaaaagaggaaatgtttcacaattaaagaattactactttcaaaacagttttctaatttctatattcttattccataaaactcccataatatgtttttaaaaacctgaactccgagggtttcttgaactttcatatttgataattatgtatgtaacaaaggctgtgaatgctcacttatgttttacaggaaatcagtaaattagaggagcgtgtttacaatgtatcrgcagaaattatggctatgaaagaagaacaagtgcatttggaacaggaaataaaaggagaagtgaaagtactgaataacatcactaatgatctcagactgaaagattgggaacattctcagaccttgagaaatatcactttaattcaaggtaaaatgtcttgtcatttctccagaaaatgatatatatattaaaatatactgatacatgcagagatttgatatttgaaatcctatggtttgaaataaatagtttytgagcttacatttactgcaaatacccaaaggaaagaatatgaaaatcagataaagacagggtacgataaccagtagcctggtatcacttaaatagaaagggaaaagcaaaatatatcttaaggtctaatgattttctcattgttaaaaactacctcataagtactgaatacaagttttttgtaattacaagtttcttcacatgttcacaaaccaagcttgttaatattgcttttccaaaacttccagtcttttttatttcttacttgactgtattattaattaaaaggatcttttgaactctccaaaataatgatggatttgtccatttcttctgcagtgcctgttagtgaaataaggtgaattggatcttacttatatayataaataaaatatatgtatatatgctttctttatatatataggctttcagttttagctttacattttagatattttagttttagctttacattatagattttttctatattttgattttttgatttctatattttgattttgattttctatattttgatttcaaccatttgcatgtatttttctatattttgattgcaaccttttgcctgttggtattctttgttttaggttagtctcttgtaatgaatacttaccttttcttttaaaaaaatatacaatctgaccatctctttgcactgtatttatttccactatcttatcatgtgctctggttttttccagtttattttatgtttcttttgctttgctgtattgccacttttggattgattaagatttttctcttgctgaatttttctctctaccaaaattaccaaacaggtttcagaaactttgtagtatatttctatttcttattgattgttgaccttaacatttatcttgaagtctaaagttgatcagtatcttaacattcatcctaaaatacacaaggaactgaaagtgctttgatgatcctcttccctagtttcctgctaatattttagtacagtttattctactttatttttttttaatcgagaacttagtcaatattatttttctttttttatacagacaatcttgtggagccttaattagggaaaagtagtcaggctggtaggaccagggaaagcaaagagaaagaagataagctataaatctgcctttcttcttggtccagaacatgtaggtccctcctgcaagaaacttgtcaccagatacctgcaagttaacccactctaaccttggtttatcagtactgcacaagctctcttcagcatacgttataaacactattctataaaatcttcagcaaacctttgtttcctggcaatcagtttctcttctgctggcctgctcattgcctccttgcaacgtattttcctgcttttgttaataaatctgcctttctttatctacaaccatcttggtaaattatttaaccctgcaccactggctcagatagtcatcgctcacccacaacaaatatktatttaaatttgcgcatgaatttaccaattgttctccrttctaaaagcacctcgggcatttcttctgggattattttccttctgcctgaagtatatcttttggaagttcatttagtgaaagtaaattgatcaagaaaccttctgatttcattttctctattttgacttgatctttgaaattgttttactatatacacacttattaggttgacagttattttgattccttctatcagtgtgctgaaaaaattggtcccctggcttcaagcttttcttgtggctcttaaaatgactgccaccaatctgtttgtcattctctttgtctttcatatctgcagttttacttatctgtggttttgtattgataatttatccatctaacatttgctgtacttcttatattagtggatttatgtctatcagtttgggaatataaccagcttcattcactttgactattgcttcttcacgattctttctctcctttcctctgtaacttacatgaaattcatattggatgttctcattccagcttccatgtctgttaagctctatttcatgattttaatattttgtctcattttatatcattagcaactagaaaaatagaactaagaacttcatgtgacttcatttcaaatacactagtttgagaaaattaagaagcctaataatcaagtgatgacaatgaaaaaaagaataaaaacaagtcccagaaaactatatatagacaatttttacttctaatgctcatagttagtaaaattatgtaaatttacagacacataaatatgtaatataatcattgttttaaaatttaagaaaatgataaacacaaaattcagggtaatatttatctatgaaaaggaaatagatgaatgagataggggaacatctaggtagataccgatttcttggattgtgatgttgcaagggtattctcattattgttgtactttatagcttgcttatacagaacacatatcatatatagtatttatcacaataaaacagatgataaagaaaaatttgaattaatcagatttttctctaacagttagatacctccactttggatttcaaataaatgtccgaagctttacaaattcaaaaccaaatccttgcttcytaactagccacccgcatctgcctccccaaatctgttgcgttttcagtctttttgttggttttgtcattttccaactacctgctcactgcctgatcttggaagctgtctttgacttccttgctctcattctctatgtaatccatttgtaagtcctactaattcttatttcatacaatatctcaaaccaaacttcttcttactctctactactactctaattcaagcaaccatatcccagtctggtgtattacatccgcttctcagttggtgtccctggctctgctcttagtccattctaaatagcaaaaaaaaaaaaaaaaaaatgctatttaagaaaacccacacaaattactggatgtgtgtggtttctctctttacactagatgtgtcttttctctctcttgcttaaatcctccaatgtcttctcattagtcttgggataaaatctaaacttctacttggtctgtcacctgtctacttctctgccctaattttctcaatcttccctctgtcatccttctgcctagcttggaaatgtggaagaatgaagtgccacgaacaagtaaaagttaatatagaaaaagtgcttgtttcatttcatgctgtccataatgaacactagacattttctctttctcttgaaaggttcttctctacgtctctactccttcttggctccacttgaagttacctcctccactttccaccattcttattctaaactcccccatctctctctaccatgatttgctttaatttcctcatagtttttaccactatatgaaatcatgtcatctctacatttgcttacttgtttagcttgtatcttctccagcagaatgtgagctctgtgaggttaagtcttctcctccttgtctacctctgcaatcccaatgcctgttagagtgcctggaaaatagtgggtgagcaattacatatgtgttgagtgaataagtgaaactaagacttttgtcttagcaagttacactctataatagcagtgtcattcttcctggtttccaagctatcaattttaattattttatatctcccaagaccaccattagttctcaacattctgtattctctgttcctttgtcatttctttatatcctcrtrtaaattattcttatgactctttgccagagttgcaattgtttcctgcccagactgtaatcctttttgcacccttgtagaatacagccttcctaaaggaagtcttagattgcataaagactctctgttgccccgtcattagacatacagttttgcctgtagcactcaaggtctttttcagtgtgtctcttaactagtcttgaatgcttcattccctcgcttgtcttttttgtatatcaaatatttcaactaatttgactgtgattctaatgtacccagtactttgtgcatcctgcctcatgtcttttcctttatttgaaatattttctctttgatttgtattcgaagatatcttgtttatcattcaaagtccatctaagatgccacctcttgcatgaagcctttgctggttctaccaatagtaaggcccagctgatacttatttctgtcttaatatggaacattaagtattctctcacaagagaatacttaatgtgatagttatgtataaaagtatctcatattctcttcgagaacagtgttcactcttcctggacacaagctacttccattagaaactgttctttatatctcttatagcacctagccataaaatatctattaattaarttataacttaagaaccatattttagaaattaatgagtgctttatcctttatcatgtgttgattgcagagttagtgtaattactttgtgttctcttttcccttatattaataatcactaaataattatacagttaaaagagacaaagattttttaatacatttctcaaatagttataataattagagccttaaagaactacataaaatttcattgtggaaatggtgaagtagagtttggtggagagttggggataacgtgatttaaagaagcaaagatgaactctagagaaaggtatttaagagaaataaaatataatatgactctgtggtgagaatagctaacattttgtttatttggaaacattttagatatattggcttcctaggatatgaaagcaccaaaaaagaaatattgatttttatagtagagaaaatgaaaaagcaactgagggcatttgaatttggagttttgtataattaattactgagattgtaacagctggactgtaggctagaagtggtggctcatgcctgtaatcccagcgctttgggaggctgagacaatataattccagcacttcaggagagtgagacatgagggccttttgagcccagaagttcaagaccagcctaggcaaagtagcaagaccctatctytgaaaaaaaaaaaaaaaaaaaaattaaccaaaggaaaaaaactgaattgtgagtttgtctaaccactatgtaaaggaaaaattcagctgaggaataatggaagaacagatgtggaaaatgaagtcaattaaatttagaacatggtagcataggatcaggaaagaaatgaaattcttctagttctgatttaacccaactagctttaagaccttgagcaactcactctctgaccctctataaatatgtttagttaaacaatgtttaaagtgtcttccagattaaacatatctaaatcaatgagcatgaaaactagagaaaaaaaaaagaagcaggtttaggcagcaatagactagaagatgtggcagatttttatgatgatctgaatatgagacaagattgaaaacggagtagaagattaatgctcataatgaataaaaactagagaagcatmgctctggaaacttagtcagatattattagtgctatgttatcgtctgaggattttaaatgatatgatacacctgggtttgtttttctagtaaattgtgtaattttgttctatgatatwgatgattatcaaatattatatatcagtacttttttgtggttatatagaaatattacttttcctttttaagaagtaatcatggaggaagctacatagtagattttgtgcatgtgttgtataaaggtaattcttcatggcagattattgtgatagtatttatgaattattcctgtaactgtaattggaaatattaaagatgaaaaataatgtaaattctatggcttcttgaactagaataaatcatatattttggccaatattaacccattttttttgacatgtatcagcaagggagctgacaggtagcattttgtccatttattgatgcaacgaggcagttattatgtcagtatggaacaaaattttgaaaagactaaatggaaactacgaacaaaaggtgactacaagagactctaagtctttattcttttttccataatatgacagaataggttactgcatttccttaatttgatagagacattgcaaaacggattcttatcaaaaagaagaagaaagccaacactgagggaactaggaggtgaaacagataaaacacattcagactagattaaaaatctctagcaatagtccagctgtgtgatggtgaagacgtgagctacaatgggaatggagaggaggctagttttggaaggtggcaaggtagtggatagtgttcttaaaagttctgcatcagaaactaagagtaaagtggtatataatttgttattttattcccccaatgaatctaaaagacacttaaaacatttattgagatccttccaacattttgttagaaacagtaaaagatctataacaatgtacaaaaatgaaacataatgtgagattaatgttacatgaagaatagaatgacaataaaaaggtacattcaacatgcctagttagaactctaacaaaaatctttacctgtttttcttattgtaggattcgaataccaggtatcagtatttttatataaaaatacagagagggatctttaactccaaattttgtaaaataatactgatctattcgctgtgattgaactaatactccaaaattaagtatacagttcccataattacatgtaatataattgaaaggatagttagtaattaggagagttccttccatctcttacttaccaaagaaatggtgagaagtccatctcagaggctaagagtctagatctattctctgtgtcccttgtttcttcttgtttcatgttctagtttttcctggaatgtctgcgtcttgctttggatcctgagttactaaactgaaatctttgcttgcgcacttttttcaaaataccatccttgattactatccctgtgcttcccttcaattagctcaacaaaattcaggcataaattgagtgtctgtcctgcttgcccccctcccctgggattcattgctatgtagtgttgaatggatgcagctgcgttcatggttatgraagttaccataactccattttcttgggaagtactacattcttctgcagggaatagggggcacatagagattccctttgatacagaaatcttacatttcttgtgcagcatttaaatatatgtctcgcagcaattaagctataccttagaatataatacaccagttaatttctaaaagccctgtaacatgttgtttgcatgacgattatgtggaaaaaaaaaatacacgtacacacttaggaaagaaatggtaaagatctttagttaaaataacacaactacgaattatattcttcctcacgctttttctaggcttttatgtttcctataagtagagttgcttttataataaaaatacaattaaatgtgtgtccaatgttgcatatgargagaaagggacattctattgagaagagtaataatgatatcttgggcctctaaaacccaaattgtaccttgaaaatgggacataccagaggaatagacagaagtagagtcaaggatgtcaaaataagcaacaacaaaatgtacaaaatatacttattcatgagatawtctttatttatttatgtggttccccctcttagatttcttcgggtattatgtctcccacctgattaaaatttgtaaacaagtgcattctaaccagggatgctgtatatatttgttttccttggactatgtatgtgtccaaactagcaattgaaaatgcttcctttaaaatatcactatttccttattctgtggtgaatctatggaataatgtttctttctgtttctttcttctggtgttgaaaaggaaactaagtgctcttctttagataaagaagagattatttgtcctctgtactccatatggaacatggtgtttaggtaggattacctttgagttctaaagacatgctaggtataatcattttaaaggcatgatgagcaggtatctgttttgctggacacagaaaatacaaatggctaaatcagggttgtttagttacagctctcaggagagccacctgaaaaaaaatgatgagaccaaagttttccttgcaatgtctccattttgtttacagtatttatagcaacctagaaattctacttaatattttacttgaaaaaagaattcctctactcattttcaccttcctgcctttcctcatgcctttctcaatccctaggaattgtcttccttccccttcccttcattcttgaaagtacccctcatatcctactttctcaatgaagacttcaaccatcaccattcacgccgatctacagttcactgacaaatatctgagtttatggtcagttccaacaaagtgctttctggttgtctaccatgtgtgaattttcctttcccttgagggtatcacaaatgtcttttaagttcttacttatagattttccgtatagtagctaattctgtattatatctaactctatgtctaactgcctaggatgcgtacaacactaatgtgactttgtgccagcctgctgtcttttctctgcccccaggttctcagaacatagaaaagtgttaggcacactcacatttaatatactgttaggttgtttactttgaggcaatgtcatcctcattagtatagggcattatattcctgaatagcagaatactcctccattcatgaagttcagtattatacattctatattattgcacaacaaatagaagactttggatttccttatataagtaccttgacagatgactaacccatttttcctatgctttacaactatgatcagtaactgtaatttttttaaaggtcctsctggacccccgggtgaaaaaggagatcgaggtcccactggagaaagtggtccacgaggatttccaggtccaataggtatggtaattttagctatttaatcatatactgtgaagatagatgatatacatccaggtacatgtgtagrggaggattgctattttatttatatcctgcagaggatgtgtatgtgtgtgtgtgtgtgtatgyacgcacatgtgtgtatatgtgtgtgtgttttgggggattagtaaatgttctagtagcctaatcacataatacactgaatgataagcattactcatgactgttgaagaaaataaatgctttaaccagagtaaccaaatggaattgttygtaagtctagatagtgacatgtatataatagacagcaaacagtataaggcagacctaaccgtagatcatatgtgaaggggagtacaacaattatctttgcrttgaataaatcatcttcacatttgcaagctatctcatttttaagacataaaaactcacactagtagtgagttatgaatcacaagcaaattggactatatttcttatatagtatttggaatatatctgtttaaactaatgaaatctgaatgtaaatattggctaaaatatggatgacacttaccttgctgacagtcactctctgtgctttactaagagcaaaactgtttcaaattattttcctctaagttgtaatcttgaaagaaatattttgaaagaagacacagaagagagaacatgaactttctttgcttgaaaaaataaaaaagataataacatgattgtcatgttagccttggcttgaaatcaaatatcctgcatgccgtttgatggtaggaagtatactgcaaggtctaattataagtagaatggtttgtgttaccaaaacatgtctaaataccatgtacttcatcttatttttctgtcttttgattatataaaaggttcttctttctgatcagtgtattgactagccctggtcacatcagaaaaatttttgaaaatgagaagcatgaacttgatacctgcctaagcacatatatgtatatatatgtatataaatatatatggcatattatatgtgaagatagatgatatacatccaggtacacatgttttatatatataaaatagcaatcctacccatatatataatatgccaagtcaggtggtattagtattgatgtgcttttgaatgccttgccaggaaagaatttttattcaggaaagtctttctacttgactaatgctaatcagatattaacaatgctgcattaatgtcataagcagaggaaataaccagtattaaatctgctgccagaactaccattgtcaagggtctatcaccccctccatacaggctgcaattgtcagagctttataactcaaccataaaaattcagtctgggctacatcttgccatacagtgcttcatcttgggagaatcttctgcagctgtttctgaactgtgaatgtatgaaatagaaggatttataaatttcagcttgtgttaatgttataaatagacaccattgcaaagaatctttgattttgttttttttttattgtaaattaacgatttgtcatggtttaaatttacagggtaaaaagtgatgtcataatttgttgcttttggtactgctcatttacacaaataggcattacccagttcctcataaaagacagrtcgagttcctggggtaatcaatgactcttctaggttatcaggttaccattttgtttggtgcactacaagaaaagtattcaaaataccaggcatctttcctaatgaattatttctggatgtcttgctgcattctgttcgtttctccaccagattgtctaattgccttatatttgatgccgaaatcaggaagcaaagagtatatgatggacaatcatactaattctgctttctaatctgagcaggtttattgcttccccatctctacatccatttgagcctactaaactcagcttgaccaagtcaaactcacctagactcacaatcatgatgcgaatatctgcaaaacctaagtggttgtcctagtagcctcaaataactaatacattaaatatagtagaattattaytcatatactagggtggatattatgtttaaatatgctttattccccaaataataacaaatttattttagagggctatttccttgaaagcatgctagggagaatgacctatcacttttcactcaaaaactatgtgctgagcactttctccaggcctggtgttctacaataccctatagagtatgtgtaaacagatacagaatctctgaattcacagcgcttccaggatgataagtagtaatataagggaggcaaatgtcatgatcaaggattttttatctcatgtragtttcttttaaggggctgattttacccatgacaacaatgttttgaaggagaagcaactttcttttctaaaggaaactttgtgtgggccatctaagaagctgtttatgcccaatgtgatcaataacaaggtagtttgacctgtaggcatgggtggggctacctacatgagatgccctcgagagaactgaaggcttctctggctgcaaacttttcatcatcaaccagtactatttacttccttacgtagtctgaattttccaccataggaatcgtgcttccagaagagaaaataaagctcatcttacccatagatattggaagagaggaaccatattttattaatgtttatatccacgtatatctttaccctggcccgccccttcccataggctatggccccaagaaggcccctccctaaagcttcagcaaggacaggatccttaaatatacacctgagtaaggaatgttgcctggctgcaggctgtcgctctacacctgagtattgaaagtgggttttttctggaagtaacaaattgtgccagtgaatcaaaaaatgtcactgctaactgtgtacgtatcatttaataaaactaaatttagaagcctttacaacaggctggtaaaaataatgattgtattactgaggaggaggatgaggaagagggggaggagaacaagaaaagctaacatttacaaagtagtcattacatgccaggcacttttctaagtgttttacgtgtatgagctcttttaactatcacatcagcctgatgatgcagaaacaaataatacacccattttacaggtgcaatgcacagtaaagttaaatgacttgcttgaggtcaatcagcaactggtaagtggcaaagctggtatttgaaccccaatgggcatgagtgcagagtccatgcccttaaccagtctgctactttgcaggaaggagcctgaatggagcaggacacctaggacatgtgaataattatcagaccagctttatgtaagtgatttgatcactctggtctcatggaactgtctctaaaatgatggattctgacttgaygatgtctaacgtctctttgaacatcccatggctgagattccatgtaactgtacttatattgtccatgagttagaagcaggtgccagaccctttcccattgccacagattattgtagaaaattagttaattgcctcctgaaagcctcagggtatctgatcttatggaataaagttcaacagctgtgcttacattttggggactacattttgaaccatcattaaacaaacaagtcacataactccataggccatatagagtctgcttaaccatctccaagaacagaggtctatgactgcctgatttctatgaaagtatctcatatgcttcatttacagagttatttgttcattcattgaaaatgtacttgatttgtagttgaacatccttgatttttagttgaacagctgtgttctgagcatcactgtgaggtacttgagaagtcagcattggaggggcttctctgatgctcttatggccccaagatgctcctgtctaaagcaggcaacatggcattctctgccatgggatcaagtgagactgggtgaacgagttctctctgaattgataatgacaaaataagatgcctaaactgttacaatagtttatcaagaactactgaactctaggataaaatattttatttcactggaatataacattttcttttatatacagttgttatgatcaccatagtaatattgggtaaaaaaaayagccattttcagttttcatttaagcatatgaaaccctggatttgtgtaagtatatagtacatactcataagtaaatctgtgtatcgcatgtktgtgtgtgtgtgtgtgtgtgtgtgtgtgtgtttatgtttatgtttatttaccctgggattacaatgaaatatgtaagaacaggtccatgatagataaagtaatatatttcagagccaagacaccaatttattttataaaacactcgttgatactttacattgcttgagttgcatttttttctaaggcaaatcttaagaattcaattttcagcttatgcattttaaagttattatttcagctacagcaagatcctgccatttgatgattactggttgactacataagtcttttggttaaaactccaagatctatttttcctaatgtgcttttatttctaccaacaatatgttatttattgaatagctacaatgtgctgaatgtactaaggtttatatttatcgcttctattgtttttcaatgtcaaacattaaattttaggaaagatattattccttcatttgaagattctctaatttcatattcacttataaaactagatgttttcattatactctcaagtctgtatgaaaatgaattattaccttctttttttcttcgttaataatgtaggtcctccgggtcttaaaggtgatcggggagcaattggctttcctggaagtcgaggactcccaggatatgccggaaggccaggtattacaataatgtgtattttctttatagaatatgtagaagaaacaccagataattttatatatatatatatatatatatatatatatacacacacacacatacacacacacataatgttatatatgtagtatacatatttttaaattcttggatgataaaaagtggtcattgtgtgaatactagtattcacatgcagttattttgtggtctagaaatgatttctgaaatcagatttttgaaactgacttctgttcacccgaggaaagtctctatatcccaaaggaaaatcgtttaaaaaaacacacaggagttataaactcctcacaatcataaatcatcackaacaatgatatccgtctttgaacaaagagagttgaaagactggcaaagaaaaaaaaagaagcaaagtgtaaatacccgtttaaccacaactggccagactttgtgaagttactgttagcaaaatacagagaagtctgaaatcctatcctctgcaaaataaattgtctgccattatctactagtgcttaagaatcaaggttgctcagcattttgaaatstacacacatgatgatattatttccatcagctctgccagtagcctaagcttaaattgcaaactttgaacagcaatcttagaaagagctaggcttactgtctcctcatttcaaagtgaattatcatcaagagaatagagtcgggccaagtgcagaggtgagtacctgtagtcccagctatttgagacgctgaggtgggaggattgcttagctcaggagtttgagacgagcctgagcaacatagtgaggccctgtctctaaaaaaataagaaaaagaaaaaaaaggaatagggtccctatcattgaggtatttttaaactacattttatttttagaacagttttacatttrtagaaaaactgcacagaaagcatagagagttcccataaaccacccatgcacacatggtctcctctactattaacatcttgcattagtgtggtatatatgtaaccattaataaaccaacactgacatattattacccaaaatctataatgtacattagtggccactctttctgttgtacattttatgtgtttcagcagatgtataatgtcatgtatccatcattacagtattagacagaatagtttcactgccctaaaggtcccctgtgctccaccaactctattcctccccaccacaatctcttggcagctgctgatctttttactgactccatagttttgccttttccagaatgtcatatagttggagtcagacagtatgtggccttgtcagactggcttctttcacttagcaatatgaatgtaaggtttctctatatctttccatggtctgattgctcatttctttttattactcaatagtattccattttatggatttaccacaatttgtttatccattcaactactgaaggacgctttggttgcttcaaagttttaggctgggcgtggtggctcacacctgtaatcgtagcacttttggaggccaaggcaggcagatcactgaggtgggcggatcacttgaggtcatcagttcaagaccagcctggccaacctggtgaaaccgtgtctctaccaaaagatacaaaaattagccaggcatggtggcatcctattcaggaggctgaggtgggaggatcacttgaacccaggaggcagaggttgcaatgaaccaagatcatgccactgcactccagcctgggtaacagagtgagaccctgactcaaaaaaaaaagttttagaaattctacgtaaagcagctataaacattaatgtgctggcttttctgtggacaggagtttacctaagagtgtgattgttggatcaaatggtaaacctatgtttagctttggagagtattatttcattcattcacccagttcacacaacttgatgaggggtcactgtgtgctggagataaatacagcacagctgcttttcttaaggagctggatacagaaaaaaaatgcataagcaattagctataatgccatgtggtaagtaaacaaccttggtgaggttggacaaattgctgtatggaagtagagagtaaggagtgattaattccatactgtaagaaaatgtgttagatagaaagtagtgtttgttagcgctggactaaaagaggcctagaatttctttaggtttgtatttctaaaactattgtaggtgttggaatcaccaggaggatgtgttaaaacagcttacaggactccaccccagagtttctgatgcagtaggtctgggattgggcttgcatcctcaccaatgtccaggtgacggtgatgctattggtccagggaccacattttgaaaaccattatgtttaggtggaaaaaaacagtgcagaaagagtaatcacgcacaaagaaaaacaacggcagaggtaataagtcccttgacaaaacatatccttaggacatcacttcttattaaaagacaccaatctggtagagatgtcagcagcagtgccaggtgctgttctagttgtactgcagastaaaagaaggaacagtacagtctctcctctacaagagtctgaagaaggtgctaaaattagaaataagtccgataattgtcaaatatgaaataagtaaaaacaggtccgtgatagataaagtaatatatttcagagctaagaccccaatttgtgatataaacactctttgatactttacattgcttgagttgtaattttttcacagcctggactatgtgaatgatatcaaaaacattatcagattctgaagcaaaaagttcaaaaagaacatcctccatctattttcttctattctccctcccacactccttttcttctcaccttgccctttccttctacatggattaagtacacactgctcgtaagggtacagtgctagaaacagggaaatgaagggtgaataagacagtctacaactgaaaagatacacaaacatgagaagagaaagagaagacttcacactttctccatgcatagcagatctatagagtagtccatttataagacctgatatatttacttcagaaagtttggaggatttaattgatgtgaaaccttgcccgtcttcaaaatccgtagaaggttctgttctaccttgttcaacatagtagaactttcagcatgcaaataacgtacttctgtctgttttgcctcttgaagtccattcaaagacttattgtttccctcagggtaagttatggtcattttcaggattatctaaaatattacaccatatgtagttcatttattaattcaacacgtttactgaacattttctctctgtgattcatggagctatctacagacggttgaacacatgagtctgaagtttcgagtagaggccagagattaaaagacaaagtttatctatgattatataaatattattcagaaccactgattttaataatattttatgggtagagagtggaaaggtacaaagagaaggggcatagcataaagctttaagtagtkccagaagtacaggctgagatgaacaaagtagcaaatggaagagaagtagcccaactgaagaagaaaacccagagaacagagcatgaaaaaaggcaaacacagagtttcaaaggtggtcaagtaaggtgaagtctacaaaaagccctttgcacctgstgctgtggggatgttgccattgttcagagcagattctgtggggtggggtgataaccagattagggtatgmggagaagggaatggttgataagggttggagatgtggtagactcaactctcaagctgcctcactatgcagaggaggaggaagagatgcattttttgttagttttgtttgtttcatatggttttttttttctttgaaggaaggatctgagtaccacttaaatgcttatggaaagataaaatagaggaggagtggctgaagacagaggaaagcaaagcaaaaaagatagtgtaaggttaatgagtggttataaggtgaggaattcagggaccaggaagaagcacaaggcttaggagagaggatgatcacatttgaaagtagcttgaaagaaacgggggatggaaaggcggcctacagctgcagaaatttggttagtgtaattaaggcatgtaagcagaaatgtctaacctagtatccggctcatataagaggctcacaaaaaatgcttgaaatcatgatgatgttattgaagacaccccctcttacatcctttcaagttagaatatcctcctacatatgacctggttcttacttttgaatggcttttagaaatataagttactttttattaaagagtaatacataggataggagatagttaactctaggtttggaccaagcccttgcattcatttttaaccaaaggtatcattctgaaggaccactacattcctctccattagaaaggatatttttgctgttttcaagtgtgagaaaagattttcaagtatcatcggtaagcaaatctctgaatcatgttaaaatgatacaaaacatttgtttgtttttttataaggagataaggcattttattttaccatctttaaaaggaaaagtcacagtggtataagaacaaaggcaaaataaaaacatgaaactaattttttatttatcatagaatctgagagctacaaggacctttcgtgggtcaagcatgtctctggcttaagcatgtctattctgaaatatctaagacaagttgctgtgtgaaaagacttctaagaacaatgcatagtttctttctcttttctcattgtgaagttaatgttgaaataatgaaattaagcttgcttattatgttctcttttatgaaaagagttagaactttgttttaactcctcccttccctaatttttaacaatttcttagagctttttcctcttggacaatctgaaaatttggcactatattttattaaagcatgctctcaaaatataggaaaggttttgggtgctttgtggtagcaacaatttttgccaatttagcagtacctgaaacaactcaattacaattaagaaatgaatttaatgatataaagtataatcacattatgcaaagcaattagagaattagaaatttgatattatgacctgatataaaatggttggcatttcattaaatcttcaaaatacaatttcaattgggaataatgtttactctttaagtgcctcaagtctcatgctactgattgtatatgttacattatatatatgtatttttttagctggtaaattaggatccaaaatcttctctaagaaatacataatgacacatgttcaaaataaagcacagatgaagacaatgtaaactagagaaatcaaaaataaatataaacactaaaattatatataattgtaccatataaaatgaactgcgatgaaaaagtttttctctcattctctgagaataaaatcacaaagagaagattccagctaagctttaggaggtgaagaataggaataagaagaactagatcttttatgtgtatcttttatgggcaaagtgcttaatgaacaggcaactctacaatgaaaagcgttatttttttattttatagaagaataaactttagctcagaaagatttaaagacttgtcccaagtcacatacccagtaagtagcagagcaaaataactcaacacaggggtttctaaattattactattattattttgaagtctatggttgttaaactacatcctctgagctctaggatgaaaaggttgaaggttctcagttttgctggagggaatcaaaaacattaacaaaggttttgactttgagacagagagcactaggatcagttctagatttatgtcaaggtagtaattacttgaagatctgattgtatctcatggctgttggaaaaaaaactcaataagcaggaacagcaccaatcttaagagatttcttggtactaaagaaagatctcctgcacacccctttaaaaatgggacagtgggtgaagtagcaatccgttggcaaaaaaaaagatctagcaatgtttctgcatccatttgaagccctgaccctcatatgaaatatttgtaccacacccctgtataaatgggtgaggtttctcaaaaccaaaggtgatcatcctggagatgtgaacgctccaaggatcttcctaccttccccatgagtaagaatctcaacactcccagaaagtcattggcagcccagtttttggggatggtacactctaaagaaatgaaaaccataaatgtaatgtgaatataagaacgggatgtgggagctcatggaaggcactggacttcctgggggtgtgagtaagacccagtcaaaggaagaggagaaaaggaggataaataagtacaaaacaaactccttattcttcagctttgcttgatttaggaaaatggggcatttagggccttgtaaataatttgaaatatcacaatattgagttcagaatggagcttcctaagtaataactattattattgttaacattatacaatgttattawacatttcaatatctgtccattctattatattttaattaccttgtgatgatctgtctccagttaaagcaaacattgtgaattgccctgattaaaaacaaatatttttcttcttttctcaaggaaattctggaccaaaaggccagaaaggggaaaaggggagtggaaacacattaagtaagtatatagtattttgttttctgtgtgaattcttgtaataagtaagtctgtgatactagagatctgggcttgaggcaaatgttcgcaacttcagcacagatccatacagactctatggaagccaaacataattttctacaaataagcatgctaattggggtaaaacaaatagattatattatacaactctttcaatctcattatccatttgtcttttgtttttgtgatgaatactattttctaaaawttccacaaagaaaattgttcaattttcaagtcaatttctatccactaagggaaaatcaagcttatgmatagaaacaattacaacctccttccttactaaatgaaaccttaaatataagaatttggacagtttaagaaccctgaaaaattaactatctgatgtctggggctcttcgtttatttttctaaaaacttgaaatgtggtattccatgttctaaacctttaaacctacaacagaatagatttcacaacaagaatatttgtcaatctactgccgacctcatgttgcaatatacacaacctgttaattggaccttaaatactaaatattagatgagatgtcttctatttgccatgctgtaagtcaattgttgtgtctaggctgaatgtatactgatataatgaaaggattatgaagasgagtgtggaatccccacttaacttctcagaatcagaaggctcctccctccctctgtattcccagtagaaactacatgtgatgtgtgtgtgtgtctgtgtgtccatgggataggtaacacaaacagggtgatcatatttaatcatcaggggtctgttttaggcagataatggcaaatccttttatgtaccaaaatctrgcagtttttatttgtaatcattatctagaaatatacagtagcaatttatctgccctacaaaacctaattattttaacctaatattgtgtaggtatgacatatttagacaaagtagggcatggttgtgaataccagccattagagtagtcattagtgtaatcatgatgctttcaaagtacaacagagtattgtgtgtcttcggagtactttagtgttacttaatgagtattactgttatattaaaacaatagaaacattaatctgtctgtcttttctccattctatccattcgttctttaatgtggtcacttttgaatgctgtatacttttttgtttttttgtttgtttgtttgtttgttttgagatggagtctcgctctgtcgccaggatggagtgcagtggcaccatctcggctcactgcaacctccacctccygggttgaaatgattcttctcccacctcagcctcctgagtagctgggattacaggcacatgccaccacacccagctaatttttgttatttagtagakacggggtttcaccattttgaccaggctggtctcgatcccctgacctcatgatctgcccacctcagcctcccaaagtgctgggattacaggcatgagccaccaagcctggcccacctgctgtgtactttttactcgacttacttctttctttctccttttcactccatttactttcagctgagytcctcttaaaaagttctccttcttatccttatgttatctttatctctgcctttattttatcttttgtttttatctccttttcctgaggctttctctgagcttcttaacattgactttagtcaagttttgcaaataagaaactattttttttttatttttacactgcaaacagcaccccactgtcttccattacctaaggttatcaaatgctttgaacattttcttcagatatgttcagaaatgttttcagttacagtattttcatggctattttggagtttatgcacatgctttctttgaggaaggagtaagagagatgtttgtatacagcctctgcattctccaccatgccctccctcctcatgcagagtatataacaactgcataatgctttaaaaacaaagaatgatatacataaacatctaatgtggtatattctgcttttcrcttatgttaatatgtcagtcatctgtccatatcattatatatgtcactacctcttttctctcaatggctacacattattctattattcagctacaccataatcaccataatatagccattcactcctctagtcctgaacactaaatgatttttgtttgctttggtcagactttaataaacaatgctacattcaacactctcacatgtaatcttgtgggaatactttttaatagggaatttgctagaagtagaatcaatggttcaaaggttacatacattttaccatttgatgaattattgtaaatggctgctaaaagcttgtaccaatttattctgtatgaaagtgcctgattccccacatctgtagttaatggtggtatgtgaaaatttatattgaatgttttcatatgcatctttaaaattttgtaaggctttctgaaaatatgttaaaaataattaatttcctcctttatatatgtgtcaggaccagtacaactcactgatcatattagggcagggccctcttaagatcaggtgggttgggcgggacatcctctgctaccatctcattaaaaggcccttcacctctggacaagtcatctgcacaactgacttccaagatccttttgtgactcctccaaatgactttggttcccgtgttgtacctgacttccacatggccttctctcctggtccctggtgctgtttgggcctctgctcccatgctcatacctcttcttactccaattactccaccatcacctctctcccctatcacccccagcctggacacctctcatgcacggactggagggctgctccaaccagtcctcagttctctgccacccattgacctagagtcttgaacccaatttaatttattgggttctaggagaactgctgtgttctcaccctaacttggaagagtgatgtttcagtcaagcaaagcgattcctaccatacaatataacacttgtgtgaggctctgtcctaaatatctcaattaccaatatgtggtttggtagtatttctcgccatgctttgctcatgcgcaatgagactacmactagggtgtaaattttaagtatcccatctaaaactcatacaatgataggaaaaatccatttgtttttcatttgatttttactgaggaatcagctcaatcttcaatgaatactggtctctttccaaagcatttttgatcaaagtaaagactgagtcaagggctttttttttttctttttcttgttttaagagacagagccttgttctattgcacaggctggactacacgcattcamctagagtctagaacacaatttaatttattgggttctaggagaactgtcatgagtattgataatatgaragttctttatattcaaacattattctcaaccagagatagggatgtcatagaagaaaatccattcattcaatcattaattcacatgtccattatgtacctccatgagctggacataacagctaataagagataattgtctctggttttacagagctaattgtccctaagagatgtagacaaatgaacaagcaattacaatacatytaagctatactgggggaggaacagggctggataggtatgcagaggagataaaaaaattttaattccttagaatattttttaaaaattgattcttattttaccttctcatcttcttattttccaaattacagcatatatatatatatatatatatatatatatatattttttttttttttttttttttttttttttaagttttgaagtgtagtcgagcttgggcaatttatccaacccatttaaaccaaaaataaaacttttcatgtattacctggtcatttcaaacaaaaatattttgatcatgaaaaagaataccaatattcttttgttctaaaaatctcttatgggattacatgttatatttttggtttctctctactgatcaacagactacattttcacaactcttctttcctttacgttttaacacacagacccaagattcatactattaagattctagtagaactctagatggtatgcctctgtgtatctcagcatttttrttcccactcttgtataatgaacatgttaacacctacctcacagggttgttgtgaggatcaagtaagatattgtgtgtgtgaagatgctctgtgaaatcataaagtcctttaaagatgtaaggtatgcttcgcagtgatctctctgaacyggaatagcttttccccgctggtataatgcagacatttttaatctgtaatcagaataggagtgaaagcaaaatgaaaatgcaagaagctgaataaatgtcatggcaaaaagagagatgctcgagaaaaagaaaagattttatattagatagagcaatgcaagtgtrrccagattgcaaatcaatgagtttgtctgagtcgagcagaagagcattagttataaataaaagaagctactaaacagagtgcacgccggagggcagaaggtgtcaacagaggtcaaaacaaaatgtcaggctaataaaacaagagtccagtctctgaagaacaaagcatgggcccaagacaatgctgatgagaaaattccaagaaaggttgaaacaagttagagttgtcaatggtactctggttttatgcctacatgacattaaaatctccagaaataaaagggagagaagaattagccacttgttcagatactcctgactattagcaggctagcaacattgaatagccagtttacacaaacatctagagataagttgtaactccttttccttggtttaattttgtgagacctcctgtcccattctgcactgcaagtcaggtagagtatgagcagctttcttcagcagaccttggtctacatcagccacacgatggcctcggtcccagagatgctgggagacaattccagggattcagttaaaaagtcatctgacatcctagactaaatatagatttttcagtgtgaaaaactaatccaaacttttcaaattagggaagaaagtcttctctctttagacaaaaaatggatgctgaatgccctgttcaaattattggcacaaatggcacaaattttatcaactttaaaaatgcataatgaagagaaaagaagccttcactaagctctaacgctagtcatagtgaatcgtctgttgtgttctcaccttaacgcggaagagtgatgttycagtcacacgaaatgattcctaccatacaatacaacacttgtgtgaggctctgtcctaaatatctcaattaccaatatgtggtttggtagtatttctcatcattctttgctcaagtgcaatgagactacaactaggatgtgaattttgagtatcctrtctaaaactcaaacaacgataggaaaaatccatttgttttttcatttgatttttactgaggactcagctcagtcttaaatgaatactagtctttttccaaagcattgttgatcaaagtaaagcctgtgaggcaagggctttttttttttttcctttrtctttttttaagagacagagtcttgctctgttgcacaggttggactacagtggcacgaccatagctccctgcagctttaagctcctgggcttaaatgatcctcccacctcagcctcctgagtagctaggactttaggcacacaccaccatgcttggctatttaaaaaaataaaaataaaaatgggatctcactatattgccaaggctggtgcaaactcttggcctcaagcgatcctcctgcctcaacctcccaaaatcttgggattacaggtgtgagccactacacccaacccaacagggtttttggtgcattatacattaatcctcagaagagcatttgggtgaaggactattatcccaatttctagaattataaactgaggcttactgctaataagtggaagaacagaaactcaaagccaggtctttaaatctccaaagtccttatgactccattcaatattcccacactagtattatgtatttttatatatatcacagatatgtcatgtggagggtatgcaaagagaaagagagggaaagagagaaagagatagatagagagagagaaaggcagaaaaggaagaaatttgtaatgagcagtttggttttctagaatgggcctagtaatttgaagagctaaagagataaaaattcttacggcagatcaaattccaaataagcattctcagttattctttatttgtttgtgtttccaccttcataactactccagctattgcctctagtctccctcctaaggatattactcagaaacatagtcttcctagaatgctcacaaagcttccattatcactaatgagagctacttatgtgcacctggggaagagctacctgttaatattctatctttattttgctaacgggctcagccttaacatttttcactattatttggctgctccaatgtctctctttttttattgtgtctttttttttaactccataatgtactttcttagtagcactagttatgagttagcagaactgagtgtacctgagtagggatggttccaggtaacttaggtaaatgctgctcatccttgacagttacatggtgtttagagctttctgtgggttcacaaattagcggtggctcacacgtgtaatcccagcgctttgggaggccaaggtgggtggatcasaaggtcaagagattgagaccatcctggccaacatggtgaaaccctgtctctaccgaaaatacaaaatttagctgggtgtggttgtgcatgcctgtagtcccaaatacttgagaggctgaggcaggagaatcgcttgaacccaggaggcagaggttgcagtgagctgagatcatgccactgcactcccgcctggagacagagcaatactccttctcaaaaaaaatgcagcattccattaacacaatagatgtgttccttaatagagtgtatagctaatacaggcatactgtggacatattgtggtttcagttccagaccaaggcaaaaaaaaagcaattatcacaatgaaacatgccagacaaattttttggtttcccagtgcatataatagttatatttacactacactggagtctattaagtgttctttaatttttaaaatactttattgctaaaaaatgctaacaatcatttgaaccttccggaagttgttatctttttctggtggagggtcttgcctccgtgttgatggctgcttactaatcagcgtgatggttgctgaagattgaggtggctgtggcaatttcttaagacaacaatgaaatatgccacgttgatggagtcttctcctcatgagagatttctctgctgcatgcaatggatgctatttgatagcattgacccactttagaacttctttcaaaattaaaatcagtcttctcatactctgctgctgctttgtcaactaaatctatatgatactctaaatcctttgttgtcgtctcaacaatgttcacagcatcttcccttcaggagtaggttgtatctcaaaaaaaccctttctttgctcatccataagaagcaacccctaatccattcaagttttatcgattgcagcaattcagccacatcctcaggctccacttctaattctagttctccacttctcttattatttataccacatctgtagtgactttctccattaaagtcttgaacccctcacagtcattcatgagggttggaatcaacttcttccaaatttcagttaacctcaatactttgaccttctcccatgaattataaattattttaatrccrtataggattgtgaaacctttccaaaaagttttcaatttactttgctcagacacatcagaggaatcactctctgtgtcagttacagccttacaagatgtatttcttaagtaataagacttgaaagtaaaaattaatcctkgmtccatgggctacacaatggatattgtgttagcaggcatgaaaacaacaccagtctttctgtccrtctccatcagagctcttgggtgaccaggtgcactctcaatgagcagtaatattttaaaaggattttttttctcagcaataagtctcaacagtaagattaaaatattcagtaaaccatgctgtcaacagacgtgctgtcacccaggcctcattgtcctatttctagagcacagggagaggacatttagcataactcataagggccctagaattttcagaatagcaaatgagcatttccttcaacttaaagtcactggctgcattagcccctaacaagggaattagcctatacttcaaagctttgaagtcaagcatgaactcctctctaagtatgaaagttatagatggcatctttttcaacagaagctgtttcatctacattgaaaatctgttgtgtagtgtagtaaccttcatcaattatcctaactagatcttctggacaattttctgaagcttctatatccacacttgctaaatcatcttgtacttttatgttatggagatggcttctttccttaaaccttatgaaccaacctctgctagcttccaacttttctcctgcagtttcctcacctttctcagcctccatagaattgaagagaggtagagccttgctctggacttggatttgtcttaagtgagtgtcatggttattttgatcatatatgaaggccactaactaaaactttatatcggcaataaggtggtttgttttcttattatttttgtgttcactggagtggcacttttaattgctttcaagaactttttctcacatttacaacttaggtaaatttcatactttcagcctgtcttgactttcaacccgcctttctcactaaggtttatcatgtgtagcttttgatttaaatgagagatgtgccactcttcctttcaatggaacacttagaggccgttgttaaggttactaatttgtttaatttcaatattgctgtgtctcagggaatagggatgcctgaggagaggaagagagacagaagggggaacagccagttggtggagcagtcagaatacacacarcatatatcaactaagtttgccatcttttacgggcatggtttgtggttccccaaactaatcacagtagtaatctcaaaggtcactgattgccataacaaatgcaaggggtcttcaaaaaatcatggaaaatatgtattaggaaaacactatacatggatttcaaaaattctgcactaaaacaagctagcttattataacatgtctgaatagaatctaatttgatgcactaagaacaataaggtatctatttaaaaagagcccctatcagagccacataaatattgctaaaatggaaccaagaacacacatgaaatttatgatgaaacttgtttggaagaakggtgaaatcaccgatactttatgaaaagtttataggcacaatgtcccaaaggaatcagcagttgacaaaaagagaactcarttttacaaagggataagaaaatattgaagatgarccctgcagcagctgactatccacgtcaatttgtgaggaaaaaaatacatcttgtttgtgccttaattgaaaagaactgagacagcagaacaacagccaacaccacagacatctcaactggtttggcttgcacaactgtgacttagaaattaaggttgagtaaagttttttctagatgggtgccaaaactattgtgtccagatcagctgcagacaacagcagagctttcagtggaaatcttaaataagtggggtcaatatcctgaggcatttatttgaagaattataggagaagataaaacatggatttmccagtataatcctgaagacaatgcataatcaaagcaatggctaccaagaggtagaagtgttacagtcaaagcaaaagcagaccagtcaagaacaaaggttctcacaacagtttttgaggatgctcaagtgatttttcttgttgacttcctggagggccaaagaatggtaacctaggcttactatgagagtattttgagaaagttatccaaagttttaacagtaaactcccaggaaagcttctccagggagtctccatcatgacaatgctcttgctcatttctctcatcaaactaggacaatttttgggagagtttcaatgggaaatcattgggcatctaccttacaatcttcatttggctccttctgacttcttttagcttcccactctcaaaatatttttaaaggacaccaatttttcttctttcaataatgagaagattacaacattgatatagttaaattcttaagatcctcaggtctttaggaatggactaaatggctagtatcatcacctataaaagtgtcttgaacttgatggagcttatgttgagaagtaaaatttatattttgtgatttttaccttttaattgcttttttccacaaactgttttaatctccccatattttactaataatggaaaagtttgcaaatcaataaatgtgattcacctcataaaactaacaacaaaaactacatgatgatctcaatagatacagcaaacrcttctgataaaattcaacacctcttcatgttaaaaactctcaatgcagtaggtgttgaaggaacatatctcaaaataataagagccatctttgaaaaacccacagcgacatcatattaaatgggcaaaacctggaaacattctgcttgaaaaccagcacaagataatgatgccctctccactactcctgttcagcatggtattggaagtcctggccagagcaatcaggcaagataaggaaatatagggcatctactttgggaggctgcagtgggaagatcacctgaggtaaggagttccagaccagcctggccmaatggcaaaacccgtctgtactaaaaatacaaaaatcagccagtgtggtggtgggtgcctgtagtcccagctacttggggggctgaggcaggagaatcacttgaacctgggaggcaggggttgcagtgagccaagatcatgccactgcactccagyctgggtgacagagtgagactctgtctcaaaaaaacaaaacaaaacaaaaaaagaaatacacagtatcaaaatagaaagagaaaaagtcaaactatctgtttgcagacaacatgattctatatctagaaaaccccatagtcttgacccaaaagctctttcagctgataaacaacttcaacaaagtttcaggatacaaaatcagtgtacaaaaatcactagcatttctgtacaccaataacagtcaagctgagagccaaatcaggaatgcaaccccattcacaattgccacaaaaagaataaaattcctaggaatacagctaaaaaggggagtgaaggacttctacaaggagaactacaaaccactgctcaaagaaatcctagatgacacaaaaaaatagaaaaacattccaagctcatggataggaagaatcggtatcattaaaatggccacaccacccaaagcaatttatacattcaatgctattcctctcaaactaccaatgacattcttcacgtaattagaaaaaaaaaaaaccctattgtaaagtgtatatggaaccaaagaagagcccaaagagccaagccaattttaagaaaaagaacaaagctggagatatcatggtacctgacttcaaactatactacaggggtacagaacaaaaacagcatggtactagtacaaaaacagacacatacaccaatggaacagaatagagaacccagaaacattgccaaccatctacaactatttgatctttgacaaagccgataaaaacaagcaataggaaaaggactcccttttcaataaatggtgctgggataactgattagccatatgcagaagactgaaactgaactctttccttacaccatatacaaaaatcaactcaagatggattaaagacttaaaagtaaagcctaaaactataaaaactctgaaagataacctatgaaataccattctgaacataggacctggtaaagatttcacgatgaagatgccaaaagcaattgcatcaaaaataaaaattgacaaatgggtcctaattagagagctgctgcaccacaaaaaaaaaaaaaaaaaaaaaaaactatcaacagagtaaacagatacatagaatgggagaaaatatttgcaaactatgtatcaaaaaatgtctaatatccagaatctgtaaggaacttaacaagcaaaaaataaacctgacaaaaaataggcaaaggacatgaacagacaattttcaaaggaagacgtacacgtggccaacaagcatatgcaaaaatgttcaacatcactaatcattagagaaatgcaaaccaaaagcacaatgagataccacctcacacctgtcagaatggctgtttattaaaaagtcaaaaaattacagatgctgtggtgacgagttcgtggagaaaagagaatgcttatcgtctgctcatggaaatgtaaattagttcagttattgtggaaagcactttggtggtttatcaaagaacttaaaacagaattaccatttgacccagcaatcccattactgagtatatacccgaagaatacaaatcgttctaccataaaaacacatactctcatatgttcatcacagcactattcacaatagcaaagacatggaatcaacctaaatgcccatcattggtagactggataaagaaaatgtggtacatatacaccgtggaataccatgcagccatacaaaagaatgagtcacgttctttgaaggaatatggttggaactggaggccattatccttacaaacacacacacaagcagaaaaccaaacacttcatgttctcacctataagtggggactgaactttgagtagatacggacacaaagaagggaacaacagacagtggggtctacttgagggtggaaggtgggaggagggtgaggatcgaaaagctctcagctgctatgcttattacctcgaagacaaaataatctgtgtccaccaaattgccacgacacgcaatttacctatataaccaaccttcacaggtacgcctgaacctaatataaaagttttaaaaaatgaaataaatcaatttgtcaccatgttaatatacttaaagataaaatacagtgctcatctaagtgggggcagaagaaagcatttgaaacaaaggaaaagtttgaaatgctgtgagaatttgcaaaatgtgacacaaagacacaaagcgagcacatgctattggaaaaatgacactgacagacttgcaggacacagaattaccacaaattttcaatctgtaaaacatgcaggatctgtgaagtgcaataaagtgaagaccaataaaacaggatatacctgtatgttgtgtcgtttgaaatagagatttaaatcaattatggatccagcagttagcacttgtcctgcttagtccctatcccagctgactctcacagcctcactctcaccagaaccaattagaaggaaaaacatcagccccatttttcacagcagcaaaagtggaaattcatgcaattatgtgcaggaatgcagatgaagcagaggcccaacactccacttccctttcctccatagcctgagtaccaagtacctttcctgccctttgaagaaacaactccaggcttcctattctgcagtaagaaatttagcctgatactcacacaagattatttattttgctcaaattcaagcactggacttgtatgggctcacagcctattatttgcccccttcagccgatcgtctctggaaatgtcctgcccttaagatgtaaatcttttttagggcgtgttgaggggatagtctctttctgtgacccaggctggagtgcagtggcatgatcttgggtcactgtaatctctgyctcctgtcctcaagtgatcttcccacctcagcctcccaggtagctggaactacaggcacaggtcaccacactcagctgttttttaaaattttttgtagggaacggggttttgctgtcttgcccaggctggtctctaactgctaaactcaaatgatctgcctgccttgacctcccaaagtgctggggttacagacataagccacggcacccaacctgaggtgaatcttaagacgagatttcctagaacgacacagttggcttgtttcacatggagtctccaagaaattcccccattatggcttagcctacagactcttaatcctttccyggatgctgtagttattttcattttctacttcttactcatatcctgcttaatccatgccaaagtaaaacattggaccctcaggtattttagggacctatataaaggaattctaatgtgaattatttagcaaaatgacccatttcctaatgacgttttatataattctgcatttttatttcctagaaagttcaaagaacaagtaaacctctttaactgcatacaaatattcagtttctgtgtacagtattttcactaaaacttcatatgatttacagcaaaacttatttcccctataaaatsattatgttttattataaaacatcttccacctcgaactcttccctgttgcattctcacttaatcctgttacccagtacattacctgcacctagaaatactatttctgcaccaaaaggacatgtgctttatcaatcacagagtgtaagctaacaaacatattattattattaaygtattaaaacatctaataggtccttcgtaagtacttatgtcatttttgaataaaaatcagcttttaaagtaggtgttttagggacaaagtgattattttcggaaaagagattttcagtgtgttcaaatcacaacatagcaagtatggtagcttaactccacctataaattaaagaagcagcttgtatttttaagtttatatgcactgaagtatgctatttctcgtttgcaagtaaaaacataacataagtgaaaaaagaaaacgtattagtctgcttgggctgtcagaacagaataccacagataaagtagcttaaattatagacatttatttcctcagagttcttgacattaaaagcccatgatcaagctgggggcaggattggcttctcctgaggcttctctttggcttgcagacggcccccttctcattgtgacttcatgaggcagtttctgtgtgagcactgagctcctggtgtctttatctcttccgatagggcacctgtcctatcaagttaggattctgcccttatgacctaattgaacctgaattacctccatatggcctctatctttaaatatagtcacattggggacttcagcatacgaatattggagcgacacaattcagtacataataggaaggtatcaagaattgatcctctgtctgtgggcaggatctctgcagcacacggctggaactgtttcaggatgaattcagttttctttgtctatgtttctgtaactttgttcttaaagagggcctaaattgcaccataagtaaatttgatgcattctggtgtttttatagttatgagaacaatttcacttttgtttactgccaatattgtgtatttacatttcagtgatgttcttttacattgtctcatgagataataaaaattaccagaataatgctgtttaaacagacaataaccaatggtgatgggattaatgacaaacaggatgacctgggcaatcacttctaatattctttgacaaataatcaccatggagatatttgtaagaactgttaagtggaaagtaacagaaacatctttaatcacaaaatagagtctattggtttacataattaagaattacaattcccacagatggcttcaggcatagcaggatccaggtgttcaaagtaaatcatttggactcagtctcgctctctctttctctttagatatgttatattcattgtgaagtcagctcttgtgtggcattatcttaacatctagccatggctaagaaagaatgccgcattttttccttcaaaataactctgtctctacttttgatcctgagctttccccttgacaagctattgtgtgtagagataagatatactcattgcctaacccgaaaagataattaccaaatggtggataagacaagatttgctttaaaaatctcagaatgcagggtccagggcactaaaaagtggatcaaactcactatcttgttcaatcatgtttagaaatagtcttgctgattgcttattgggcggcgatgtattagtttaattcttccataatgcgaatgatttgtaactctctaagtggtcatatgtattctagtattgttctagaagttgggctcaggatatggtgaacatcagaatgactcgtgaggcttttatcatataaagatgcctggacatgacacacagatattctgatttcagggagtttgtgctgtggccttgatacatgtgatytccaaaagttctccttgggattctgaagcacaaagtagwtgagaaactgctatttaatatatgatacttttkttctcccatcacctattccccatcattaggccagaaatttgaatttttaagaaataatagtatcaataatacctataatgtgtagaatgaaccctctgtaccagacactctgaaaagcactttatatacctcctttacttaatccccacaaggaatctatcactctggtgttctccccatgaggatttagaaccattaagtaaactgtgcaaaattatacctatggccgggtgcagtggctcatgtctgtaatcccagtactttgggaggccaaagcaagcaaatcgcttgagctcaggagttggagaccagcctaggctacrtggtgaaatcccgtctcttcaaaaaatacaaaaatatctcctcttgactctgtcccaaatacttgtctccctggctttaggagtaacacaatatgttatgttatttttctagagaaattttctagagaaatttaactcagtttcttcaggtatctgatatttgggttgcacatttcattgctaagtatctcattaaggtaattatcttaaataaagaatcagttatcttcttaaaggaattttgccatgttgtgagaactttcaggtcaaactgcaaccagatttttttttaatttctgtattatgtttgcatctcaaatatcataactaccattgtaataaatttaaccctaaatcctaattccaataaatgatacaaaaaggaaatcatgactatgagtaaacaataggataataastgttatgctcctcaaaagtcatttctatgttcgattatttctttccactgagtagtggtaattgacacatgcaaagaagaccttacatgttccctgacttttcaagtttgaatgttgtctttctaacagcgatgaatagattcgtagtatcttttctctaacttttaagggtagactcatatatggaacactttaaataatttgtgcagggttcaggtatggctctgtgaacattgcagtgaatgtgttgtttccttctttaaataaaatatatttcaaaaataaagaaaagaaataatatttataataaatagctaatacacagtcatgtgtaccacttggacctttgaaatgttcacatttaccatcttgaytacaagtatttgttttttaagagatataattttggctgggtgcagtggctcatacctgtaatcacatcaccttgggaggccaaggcaggaggatcacttgagcccaggagtttgaggctgcagtgagctatgactgcaccacagcacttcaatctgggagacacagggacaccttatctctaaagaaaaacttttaaaaatttttaaaagaaatacaatgttatgagcagagttgaagtaccagtatgtctacctgtcttccttwccagggtaaacctttatcctggagtttgtttccttccrttcatgtttttgtgcatttactacatatgtatgtactattcttatgtcccagttctttcctaaagaaaggattgaaacttctctgaaactagctaactcattgtcatagagatgtaaagaaatgggacataagaatagtgagattgcctttaaaaagttaaactatagaatgaacattcaatgaatcagcagagatatgtcaaatcattttacctgactgaatgtattaacatatataaagaaaaatgtgttaacgaaagatcattggccatcccagaagcaaaatctcactgctaagtctctttgtaaattaataaattaattaaactaagagttcactcactgtgatttgccttcccatgcagatttcccaaggggagaaagtggccttgtcaagcagattcaaatattccagtttttaaggcaattrcatttctcattgtaaattgaattgacatttagtcccaagattctgtttaacattagtctgcctctaagagatagatctgctcactgagctgacaagatcagattttctaatgtctcaggcttctctgatcagagcctcccaccaaaagctygtatttggagaggctctcagtagccagccatatgggtttttttccataaaaacacttatgtttatgccagttaaatcaatctttccttcatgatttttctgtttctactcatagaaactatattctattccctctgaagacttatgaaatattaaattcagtttcttctatgatttgatattttaagcatttgccaatttaatctcactgggtaatgcagttcatgtatcaagagaagcttaccattcatttatttactcattcatgccataactcttcctcaagtgactactgagtgacaacttgcatcttgtcagatgctgaaaagatgactataacgggtttctttcagtctactggggaaaacaaacaagtttactgcagtttggtatagcatctgtaatagtgctattgagtaaccaatcgaaatttggagattgagagtgtagaaatgagaggggaagtgggaagggaagaaggaacattccagacaggaaccaaagccccagaaataaaggagaatgagacttatttggaaaatgtgagtagttatatataaagtaaaaagacaaagcagtgcaggtggggagaatttctcaagggttaggttggaaaggtgagcagagattaagcatgaccttatttattccacaagtcacttgacaagagtattcccaggaaatcctctatcattctcgtctactatgtttgtaattctaccagggattcccaaactttttctgtaaagaaacagcaaatatttgcataaatgcaccaagattattaaaatatcttttatggaatggacttaagattttttgtctgctcaaaactctttcaacaaggaaatgcctccccattctcactgtgggaatgccatgttcatgcaagtgactcggcctgtttgtccagtccacaggtgggcatttggcccaaactaggccatagaagaacttccctggatattttagaaactatcactaagaaataggctgtaaaatatcaagttaggtgagtgtcagaactgtcagtctgtcactgagaaagagacagtaactgtcatcaagaaagaaactgtaaaatataaacttaggagctgttaacagacatgttctatcaagtgaacaggagagcaaagatatctagcttgcaacaaaaaaagaataataaagcaacctacagaaagaagcttgagtacaagttggagactcctaagcagattcgggtcttgggtcagctattgcagatacctawctataatcttatccttgggttctatgaaacatccagtgtccttaaaatacattattattttggttttggtttaaattactttagtttctgtttctgttttttcaccaattaaaaaataataatacacgaaatcgtttaggcacatagtctatgcttatctgtgtttatttgatttgaatstagaaaatgtctacacaaataaagaggaaacagctatccagaacacacacacacacacacatatacatgtcttctgaaatctttatatacaagataaaaatacccaaatggaaaaaaaaaaagccctatctgactaaatatattagcttgttgccaaagaaacgacagacattctttacatctttgtgacagtgaattagctactttcagagaagttttgatccttcagtcttacagagaaaatcctatgatcaaggttgatgacaaaatgaacttttctacatcaccaaaacagagcagttgaatagtaggtgaagccaactctcaaatgagtctactgacctattgagacgcctttcctctatattacttcagagatggtcaaggatcagcaatgtgtggtcacctgtcaatagtttatttataactgaaaaatatttcaggtgacagatatggatcagcatacccaagcatatttggccctaaagaatttgaatagagggccgggtgccgtggcttatgcctgtaatcccagcactttggcaggccgagtcgggcggatcacgaggtcaggaaatccagaccatcctggctaacacggtgaaaccccgtctgtactaaaaaatacaaaaaattagctgggcgtggtggcaggcacctgtagtcgtagctactccggaggctgaggcaggaggatggcttgaacccgggaggtggagcttgcagtgagccgagatcgcgccactacactccagcctgggagacagcaagactccgtctcaaaaaaaaaaaaaaaaaaaagaatttgaatagaggtacctactccccctcaggatcccttgagcatacggaatttggcagaaatttacagtcagccattccctttgcaataaatgagatgaaaggattgtatcagcagcactatctgtttctgatataatatgtctcctcttctaaatatatactgcaatcatctaggttagtggttctcaaagtgtggtccctggaccaacagaattagctgttgggagcttgttctgctgcatattattctttgagaaccactgctccaggacaagcaaggctcatttatgacattttggaaggagtaagaggtaaacaatgggcagtgagaatgcttacattcacttgtttggacaacaggacaacgatgctcatataatcaaatgtttgagtatgcctgatttttcatagcatgcatgcatgataaatatattatgtttggatatatttgacttgtataaaaataaacatttrgatatcacactagttaataaaacatgtctctaatatgtaaaggcttctcacaatccattcttggatttttctttctcsttttctttaggcaattacaggaaatgattgggccactcaggaattttactagtaaatgaaagttgaaatactataataacaaattattttcatgttttaaagtgtttttaacttatgcttattaagtgaagaaggacttatccactcaggcatgcttacactaaatcagtatttagcactgaattatattttggaagaatcaagagaataattataattatatatatagtaacatgccaccttttatgtttctgcatagctcaggtcactcaatttcattacaggaaattgtcagtaatctaataactttaaatgttattaaattactgttaaaacagtaataagcataagttaaaaacatttgttgaaacagtaatctagtaactttaaatgttattagattaccgttctaacaaaatgaattcaaactggagaaaaagaagttactgaatatttcttcaattaattgagctccaaaaacccattccttaaaactccattttcacattagagagatatttttgttatgaaaattacatcttttttataatataacattcctcaaacttatatttgaaaagctatcttttgtttaygtagaattacatttattagtttttatgattattagaaaatattatttttatttaatattaactaaatttttaaaaataatttttcatctctgcctttcattctgttctttagccaaataattttctaaacaaatacttagcagaataatacaggctgttgagagatttttcatacgccaagtgaattgctcttataatatttgttgcactattttatttaatctgtcactaggtcaaagtgcatatatattggtttttaaaaatagaaaagagccatttcatatttatgtaaatctttctgtagcatgatcaagattttacaaaagtttattgtacatatggtcattttgattagacattacagaacaaaattacttttataattataaacaaagtttatttctttgtagtttactatttgaatcacttctaaaaataaacaaaattgtctgattttttatctcgttaatatttttttctaaagaggaaaaacacaaaaatctttgttacagaatccaggaacctcacaacaaggaaagtctttgctatttctaaatgaaggttgtcactatagttccyttgtttcccttggkaaaagatatgaagtttgatcacctatttttgtgtttatgatattctaaaatatctgctcctcgccctcctatagtattgaaaatctctgcattgtatgttgataagtttgtatgtttgtatgtcaagaaaataatgaaccatttagttataatttttcaatggtatgaaaaaatctaagtgacaataaacttgtatctgtcaaaattcaaactcgttggaatataatctgtgacgtgtcctcgtatatataacttacatgtaagacagattggattttgctcttaacagctgttaaarctgcaatatttgcagttaaactctttaccaataggtggtgctagaaagtttaatatttattccaatagttgaarttatttggaaaatgtgctaaacatttttttgtgtttaaaaaaaaagtsctrtaaagcagtatgtacataattagtccttgcttgccttttttttttttttttttttttttaactttacagctccatttacgaaagttcgactggtcggtgggagcggccctcacgaggggagagtggagatactccacagcggccagtggggtacaatttgtgacgatcgctgggaagtgcgcgttggacaggtcgtctgtaggagcttgggatacccaggtgttcaagccgtgcacaaggcagctcactttggacaaggtaatttaaagaaaatcttgtgaggtttgttgttgttgtttcagacagagtctcattctgtcgcccagactggagtgcagtggcgcgatctcggctcactgcaacctctgcctcccggattcaagcgattctcctcccttagcctgcctagtagctgggactacagccgcgcgccaccacacccggctcattttttgtatttttagtagagatggggtttcaccgtgttagccaggatggtctcgatctcctgacctcgtgatctgcccgcctcgccaacctaaagtgctgggattacaggcgagagccaccgcgcttggccagaaaattttgtttttaaaaaaatgaaatgtaggcattctctaaagacagagaataaagtagtgacaggaacatagtctaggcttggtacagtggctcacgcttgtagtcccagcactttgggaggctgaagtgggaagatcactggaataaatgagttcaagacyagcgtggacaacatagtaagatcctatctctaccaattaaaaaaaaaaaaaaaaaaaaaagccaggcgtgatagcatgcacctgcagtcctagctactacagaggctgaggtgggagggtcgcttgggctcaggagttccaggttacatgagctatggtcacgctgctgcactccagcctgggtgacagagcaagacctgtctctgaaaaacaaatttttacagaaaagtagaaaaaggtaagatgaacttctcaaatgcctagaagatattaccaagtgctaatatgctatgatttattgagtaatgactatatgccacgcattgtgttaaatrcctgcatagcgttaataataggtcacaatcacatcctttactattttacctaaaataattttcatattaggctgggcatggtggctcacacctgtaatcccagcactttgggatgctgaaggtgggtggatcacttgaggtcaggagttcgagatcagcctggccaacatggtgaaaccccatctctactaaaaatacaaaaattagccaggcatggtggtgcacgccggtaatcccagctactttggaggctgaggcaggacaattacttggacccaggaggtggaggttgcagtgagccgagctgcactccaccctgggtgacagagtgagattccgtctaaaaaaataatgataataattatcatattaggtttaagagatggatttaagcagaagtctcaggttctagagtctttaggtcccagaaggataatttaatttcatgaagagaggagatgtcagaaaatagactggtaatgtgcagaacttctgtagccagtttcagcccctggccgtagtttttaacttgcaccctaaaggtttacatagaagaaacaaaggaaataaacagcttcagagagatctgtggagtttccaaattttccatccctgtcccatatttagaacatttttcccaggttgaaaagtgtgggtttgaaatcattcttgcacctataaaatttatctccaaaagtaaaatagtaagatattctcaaggtcaayagctagatttttgcttttgttttctttgtttttcttttttgtttttctggagaagaggaaaaagaaaaaatcctcaactcttcatccctagagaattgaatgatgccatcagttatttaacaagactgagctcccaatctgagtttccacattggttttctgttttgtttttgtttttgtttttttggttttggagacagatctccctctgtcacccaggctggagtgcggggtgtaatctcggcttactgcaacctctgcctcctgggttcaagtgattctccctcctcagcctcctgagaagctgcgactaccagcatgcaccatcacacctggctagtttttgtatatttggtagttatttttggcttcccaaagtgctgggattacaggtgtgagccacgccacccagcccacgtttccaaattgttttgtgggaacagaatccatttctatgataactaacatccacagaatgaaagaccatttatttaaaatacataattgtataaaacatttcaagtgactgttaccatctatgaaggggacacccacagttctaatagaggacataacgagtcttatccatgctcttagtcacctggtaaatgactgatgattcttcagctttagaaataaaagatgttttggattctcaagatgtgcttttgttgacaaaatgaagtataaaatttgccagttatttagataatataatcaatgcagacaagctcagtataaaaaaaagaaaagtatcctaaaataccactagtctggatgaattattytgatgcttatattatgyagagatctgacaagtctgtatttagcattgtttctttaagacagtggttcccaacctttttggcaccagggaccagttttgtggaagacaatttttccacagaccagggatgggagaaggtttggggatggttcaagcacatgacatttattgtgcacattatttctattattattatactgtaatatataatgaaatgattatacaacttattatgatgtagattattccactcactatgtggaatcagtgggagctctcagcttggtttcctgcaactagacggtcccatctggggctgatgggagacagtgacacctgaagtgtgttgcttatgtacagtctactccataatctcactttggttgctatcactgtagaaaaccctgcttcactaagatagcatgttggaaatggaagcaggcttttcagtgcttttgtggcaatttcaggatattctgcttygaaagtttaatccagaatgtatggaaatttgaagttstctcaaacatacctttaaaggcaccaaaagcagctgtacaactgaagtacatcaactcactttcgactctaaagcctgccatcagatgcagcttgtcactttccactcactgacagggtttttgatatgagtctacaagcaattgatttactattgtctctgtgccgtcacacctctctgctaatgttaatctttatttgcagccgctccccagctctagcatcacggctgcagccccacctcagatcatcagacattagattctcataagaagcgtgcaacctagatccctcacatgtgtaattcacaatacggtttgtgttcctatgagtatctaatgctgccactgatctgacaggaggtggcactcaggcggtaatgtgagtgatagggagcggcagtaaatacagatgaagctttgctcactcacctgctgctcacctcctgctgtgcagctttgtttctaacaggccatggacactattggtccatggtctgtgggctggggacccctgctttaagaaactagcccagtagtacagtggctgaggtgaggctttttcatctattacaaagagaaaatcaaatggagagcaacagtagtagtatatgtactttaattcaaggaaagctagtaagtgctggcaacatacagcctgtagtatgaaagtgaacaagacgtcatctctagctttatttcttctctgagcatgaagctttgccatggacttcaaagatatttttccactggagttacaaacataggtgagaaaaacatagctgaagactattgtcctaaaaytgtattaactttaaggcttagtctcatgagtaaaatagtattttcctcaaaacttttattcattcctgcttatatctctataaagtagggatttctggtctaaagaactggtaagaaaggaagataataagtatactgagatactaagaagaaaatggtttttttyaaacttaaataaggaatagaatgacagagtttagtctcatgtgaagttacttacttggctatgtggagataagtctctcaagttttcttgacataatttgtctaaattttcaggaggctgtttgtttatggtagttggtgattctatacattgtcccagagttttattatcatcaaacaataaagtgggtcaggattttggtttccttttacattttttcagcatctagtgaagcaaactggaaagattaggagttttctaacttaaaaaattgcaagtttaaattttagctgtggttattgtgtttcagaatttcaatttcctttccaataaaatgagaataatactgacctggcagatttgttttgaagcttgagttaactagcatatggaaagcacccagtacaaaatctgactcacaatgttgtattgctcactactgaaggagatcactgctagcagcaacacaaactgtgttatcacacatttatttgctattctctttgaaagagtsagatcgctattacattgtatattgacatcagtgatattccaaggctaattcaaagtagatatcccactaatatgacttagattttttattttatagacagggtcttactctgtcacctaggctggartacaatggtacaatcacaggttaatgcagcctcaaactcctgctctcaagcgatcctcccaccttagcctgcagagtttctcgggaccacaggcctgcaccacatacctggctaatttttttttaaatcttaatttcttatagagacaggttcttgctaagttgctcaggctcatctaaaactcctagcctcaagcaatcctcctgcctcagcctcccraagtactggaatgacaagtgtgaaccactgcacctggtttgacttagctgttgtttccactccctgcgtagagttcagtaccaaacaactaaagaataattatgagaattttaaaataataaagcaaaatgagctgagagaaaaaaatagaaccaacattatttgttctgaagaaaatgatttgaaaagtaarttttatgatctacttcactggatattgtattttaagagacaggcttacattattcactgattggggattagacatggcaaacgaggtttttatggaaagctrtttaaaacattcctgattttttcactcctccaccttaaattcacagtttcactcaagaggaaaagaaaaagcaattttaaatacagagtagagacaagaaaagaaacttagaaaaatgagtggatgagtaaagaactaaaagagaaacatgcattgttttaattatttatccttctcttaggaaagtgagaagaatcaggttcatatcatattgtacatcattaccaaaattgaaacaaaaagaaaacaatttttttttcgagatggagtttcgctcttgttgcccaggctggagtgcagtggcacaatctcggctcaccgcaacctctgcctcccaggttcaagcgattctcctacctcagcctcccaagtagctgggattacaggcatgcaccaccacacccaactaattttttgtatatttagtagagacggggtttctccatggtggtcaggctggtctcgaactcctgaccgcacgagatccacccacctcagcctcccaaagtgctgggattacaggcatgagccactgtgcccagccagaaaacaatttaaatgaaccctctttttataatgcaccattatagaaagaatataatttttggacagtctccacatatttttttctggttttaaatagcaaacctggcttagcagatagaatccttagttttaagaacaattagttttgcagctgcaggtaaaatgacttataggaataaagtttcaagcatgctcctttaaataggttctctcatttggatgcacctttttttctgactagacaaaacaagtttaattaaggaagcactgaggggcatctactgtttatcaatgcacagggcagggaaaggagagtgagtcactttttgccccgtatccaggctttcccagctattgtgcctgtggtctccctgcagcaaacttggatgagttttatyatacaacagtggtacctccaagaatttgttccaggtatatctgagcctgtatggatgctgatgagggaagtaagatctggagtaactattgcttcttctcctgagtttatagtgctgaaactccaaacctgaaaagagaaacaaaagtaatatataaacataaatgccatttaaaagttattcttagctgtcttttctttgcttttttattaccacttttacataccataatcaattttctatgtgaaattttcaaaaaaaaaatgtaagggtaaacagaaggcaatcaaaaaatgcacctctatacctctgaactatccyttaatgaatgggagtaaatataatctcaaagataaataaatatatcaaagggtcacaagtcaaatttttacatactgctccttgcatgttgaatgttttaaaatgtaaacatttgaatgttaaatattatggaaagtagtatagggctggtccatacagctgggtaatcacagaaaaatagcatatttttttcatagagaaaataagtagggctagcagaggtcatcaaagttgtacaaatttacgtagtcattatggtggttgggggtggttgggggtgggtgggagtgggaagaagggtcaagattcatgccttaacctttctctcataccatgctttctccaccagatggaacatccttccaagtcctttatacttaagatcttcatttctaaagagcttgcttcttcagaatcttagtatcatgaaatattaaaggtagacaaagtcttaaagctatgttagccttactcctttattctgcatatcataaaattgaggaaaaatgagtggtttctctataagcacaaaactacaatccaaactataggctatattgacccattcttctctactttgattcccaaggtgttttcaactttaatttacattgtttttctcaatggagacactgttcacaaaacacttcccaactaggcttaaaagtcatacaaatttatgtcactcagtcatgactagaaataatgaaaatacacattcaggcacttttaactattaatgatatttgctctcccatttatctattcagcagctgatctcaaatctcatcattttataatatatctggatgatgtatgaaactgattaccttttatttttcatggaaatgctggtaagattaaagatacccaaatcccccaaagaaatatcagtatctttcattttttaaaaagaggtgaagaggaggtcaggcacagtggctcacccctgtaatcgcagcactttgggaggctgaggtgggtggatcacaaggtgaagagatcgagaccattctggccaacatggtgaaaccccgtctctactaaaaatacaaaaattaactgggcgtggtggtgcacacctgtaatcccacctactcaggaggctgaggcaggagaatcatttgaacccaggaagcggaagtgcagtgagccgagatcacgccattgcactccagcctgggcgatagagggagtgagtctctgtctcaaaaaaaaaaaaaaaaaaaaacttaaaaaaaatatataatcaatatcaatccctacaaccctcaaattataarggaaatcatagatatatatatggctaggtatataggtggaaagatgagagagagagaaagagaggaagaggattagagattaaaaacatatctaagaaacacacgtaatttttgtatagctttccaccgaatagaaagaatagttcagaggcacaaaaaaaataataacagtgacagccccaacaacgaagatccttgaataacagttattatctaaagaaataaaaacaaatttgttttttatctcattggtttacacaaggataaaattttatgaattttatactatctgcattaactttttaatgcagaaaacaatttggaatgagayggaaaatgtgtattaaataaatttttcccctgggctcaatagtcttgaatatattratataaaaataaaacaacaaatctttggaaattacttctataattctatctagacatctatgtaacccatgaatatcactaagctttaagtgtcatcatgttctgttgcctggatctattctttgtaaatttgagaaagtcatacaccstttctcagtctcagtttatgtatctrtgaaatggagataattatcattatttaacaaggtkwttataaaaagtaaatttagaaatgtatgtgaaaagacctagcatattaccttatacacaagcacttaaaaaattttcactgtgtctgaaactgttccacatagcaaaagacagagataccaaattccacaatacatttgtcwcatcyatgtgtcctcagaggaaaaataaccagaataagaatcagaggctctagatgccagtatttgctctggcatgattgtatatgtgatctcagttgcttcatctacctagaacataagccctcccaggaagtcagtccacaagagtatggagtttggtcttgttcactcgtgtaggcaccaaaggagatttgctaaataagtaagtstaataatgaaggaggttgcagtaagtcattgatttaaggcagtggctcagggtggatacagggtgagaatcctgtgcgactttgagcacgtacagttccttatccttgctgattttcagtttcctcaacagtaaaatgacacaataatggcattcagtttttgaaagttatttgaggattgcatggaataatacatcacatgtataagtgtttcctgccacataagaaattcttaaaagactggacttaaattttcattatcaggaccacaaccttggtattctaacattcgtgaattcccttactgcaatttctaaaaacatgtgcttacatgtcagcacattagtcaactaaataatttctttcctttgctrttcatgttgggatggccttgctggtgctgtagacattgggagaattcccactctcagtttccttttcctggattgtacaaattctgcactgctgaaatctaaattcactgagtagacctacaaaatacaattcgaaagcatcacagtagcccgggttcacaattcatggagccattctcgcactctccaaattatgacagagccatggctttcaccaaaagtttaatttctgtttgtttatacaatttataaatgacaataaatataatagatataatttataaatgtctcgtacttcggcttcctcctgtattaacatgggaatagtcttactatttgtgcaattgtttttatttgcctgtatttttaagtagccctttgaggctttcaaaaagtttttatagactttatatacttataaggaaacacagatatacaaatacgtatacacatacaaacatgctcacacatacaatcacaaacacaataggaaacatgccatgcctagtaagataatttgggaactaaaaagtgtccctggcaaggtttctgattttgagatcatattccttttttcttttccttcttctgccttaaaatttcaagtaaaaaagcctcaatactgttataaacacctcaaaaaatacttgggctctccaacttactgttaacactcttacaattgatcagctcaggaaaacctttgctttgtcattttcttgctgtttgtttgtgtttgcaatcagtagcattcttaatccatgatttccttacaggatggtgtgtaggccctttgctgattagattagttctactttaattaaaaacagataatgtatttgataaaccaggcacacataaattgaaatacacgggaagataacaaaaggaggaagatgctgatattaagttttcctttttccggtttattttatgtgcaaatataccccaagaccctttgacatacagatacgcttggatcatcaggttattacatgtacccatgattattaaggctcaaactttcttctttatttttagattaataataaaactaatttgtcaaatccttaaaaaaacattcttaatctctacttttatagaactgtgtaggtaactttgttagagctcttcttactttgcattttagtagtttacatgttaacagagtataaagtgttctgaagcaggagattaatttttgattyctactagagagcacagaacttgcatacagaaaataatcaacacttttttgtttaattagtgaaggaattaatggctttgccccactcaaagagaaacactaaactctaaacttactaatgcagttatacctcattattgcaggtactggtccaatatggctgaatgaagtgttttgttttgggagagaatcatctattgaagaatgtaaaattcggcaatgggggacaagagcctgttcacattctgaagatgctggagtcacttgcactttataatgcatcatattktcattcacaactatgaaatcgctgctcaaaaatgattttattaccttgttcctgtaaaatccatttaatcaatatttaagagattaagaatattgcccaaataatattttagattacrggattaatatattgaacaccttcatgcttactattttatgtctatatttaaatcattttaacttctrtaggtttttaaatggaattttctaatataatgacttatatgctgaattgaacattttgaagtttatagcttccagattacaaaggccaagggtaatagaaatgcataccagtaattggctccaattcataatatgttcaccaggagattacaattttttgctcttcttgtctttgtaatctatttagttgattttaattactttctgaataacggaagggatcagaaratatcttttgtgcctagattgcaaaatctccaatccacacatattgttttaaaataagaatgttatccaactattaagatatctcaatgtrcaataacttgtgtattagatatcaatgttaatgatatgtcttggccactatggaccagggagcttatttttcttgtcatgtactgacaactgtttaattgaatcatgaagtaaattgaaagcaggacatatgagaaaactgaccatcagtatatttgtccagataattggtggatcaaaaatgccacttaacaggaagtttagtttgttatgcactttaaatggaataattagcttgttacaattctaggacatggtgtttaaaatttaaatctgattaatccattttaacaaacaatgcaaacatcttcagtgcagaaggaagagtggtttcaactgtttggagtcttttatgaagtcagtcaacatttacaaccaaagggcgggggggggggtggggggtgcgtctttagtcctaaagggacaataactctgagcatgccccaaaaargtagtttagcaaccttttgttggtagtcaacccatccccagggccatagtgtagagtgtgaaaagctaccctgaaacccagtaattctaccctgaaagtgactgcctgcagaaagaccagcagttgatattaaagcgcaaatgaattcaacctcagccctgaaaataacagaattctgaagtttcctatgactaattcacaaaaaaagtaattgtaaactagtactattatggaattactctactgttctttctttaatagtggcaaatgaaagcataagcttaagcattttttcatattctgaagtctcaccacacataataaccaagtggtagactcacagccgtccaacttaaaaaggcaaaaccttaccttggaattggaattactgtaaacagcctactgaaaatgcatttttatcatgtaacattcttctacttgtttaacattgctgattttctctggcagcataattttgtggttaagagaatgaattctgaatgtacactttctgtctcaaaccctggctgtaatttcagctagttaataattctttgtgttcagttccactatctaggtattttcttcaaaaggtaaatacaatggtttctgaaagaatcatttgcattatcagcctgtttgggatgtctgagatcagtgcctctgggttgttaatactgtattgctgtatggtatatgtatgctgatttactacttatgcgtaagtggtatgcatgggatgtctgaaatcagtgcctatgggttgtcaatagtattaactattagtgttaactgttagtattaactattagtattattaacactaataatagtactattactattactatttttattttaaaataaaatttacctttaaaataataatagtactattgctagtactagtactattgctattactagtactattactagtactagtactatgacactgttaatagtactattaacaacccataggcacttgggatgtctgagatcagtgcctatgggttgttaatactatattgctgtatggtatatgcatgctgatttaccacttatgcatagatatatctttaataagtaatctaaaaatcctttttgtatttgagagaatctactaagttcagtccagtcaagaaaagaacctaatagcaccaatacaaattgaggacttaatttactttggaatgttgaattgcatttgttccattaaaaaaaacagaaatttgcgatttggtttttttgaaaaaatagctcagctgaccagaatgaatgtattctacttgttgagccatccagcatcacgttaaatgcaaaatgtatatataaataaaagaagaagaaaaaagaaagaccaaagggatgtagaaaatgaagaataaccattaatatctaagggccaaacacattccacctaaattatctaaatagtttcaaatcaaaactttccattttttcaaaacgtatagaccatagtagtttgtacttaagtaaagcattacattaatttgtaatgtgcctattacaaataatatacagttgacccttgaacaatgcagaggttgggagcactgatcccttcacagtgaaaaatccacatataacttttgactcccccaaaacttagccactgagagcctactggtgaccagaatccttaccaataacataaatagtcaattaaccatttttgtattactaataatgtcaactaacacattttatatgcatgatgtactgtattcttacaaaaaaataaactagaggaaagaaaactttaattaaatcataaggaagagaaatatatttactattaatcaagtggaagtgaaccatcataaatgtcttcatccttcattgttgttttcatattgagtagtctgagaaggagaaagagggggagttggatttgctgtctcaggaatcgtagaggtggaagatccatgtataagtggaacagtgcacagttcaaacacatattgtttaagggttgactgtaataatatttgctatgaagggtaaaatgaaatatttctaccctcagtcatttgtttgatcagtatggcagtgatatgtatgtccaaagcaatcacactcaagagatacaaatttaccatcactgggttacaatggtaagcattatttactctccggagttggagaagctcaaggctggtgaagctcaagatctcatgttaactaaataaaatcaagattatggcagagaggaggaaaaagtcaatgtttgtcaggtagacaattaacaatgttccctcagaaaagcacaattaggagatgattacgttgagatttttttaattcattgagacagtatataggaattttaggaacatgtgtttggcactagatgtggttttggcttttaatcacacataaaaccataatatagcctgatttttttcaactatgcattttctttgcactttttctttattgaatggtaggtaatacattttaaaatgtttttctttaaccacaccaatcttctggttacataacatactgaaatatgtattcctttctgttatttatcagctattttcctttgcagagtaatttatatttaaaactcttagaatttatgtttttaaaatgttaatatcttaacaagaacttatgtatatgttattattgagtacatttacttaaacaaacaaacaaaaacaaagagcaatattaacaaaatggtggagtaggcagcttcatgaattcattcttttagagaaatatcaaaaaataaatagaaactgtcagaatcaactttttcaggactctgaaaaaattcagaattttacagcaactaagcaaatgttgagtcaagaaaaaggcaactttgaaacaacagtaaagtttgtgatatttttacctgccttccccctacctcctcctggatgcagcaatgttttttttttttttttttttttgtcttgaggtagtggtaggcagtctacattcgtagcttgggcccttgggccctggttccatgggaagcagagatgaccttcctcacaaacagttgtgtttgtctgttttaatctgtctaagaaattccctgaaggactgatgcaaagcattcaactctgtttcacttaattttgaattcaggttggtaaagcagtggccgttgttcaaaaacactgttagctgaaataacaaccctcaaatgcatgggtcacaacattatagttgaaacatgaagtagagagcataaggcctggtagcaaaaactgaagacagtttctttgggaaattagggtgtttaaaaaaatgaatgcagggaagtttagaaagccgcatgcatgctcagggcgaaacacatgccttgaaaagaacctaaactttcaccttgggctgatctctaggattagtgcaaatctggctaagtgttaacggcgtgcccaggctcagaaacaatctgcaaatactgagggagatggattgttgttggttgtgttggttgctgcagattttgtgttttgtcttttatttctgtttttagtgcttggcattcaaaaacactagcttaacacaaagtaaggaaaagagactccagtgatcatcaacaataaggaacacagtcttggtaaaaatcattcaggatagtcacaaaacaaaaataagcaaaagaaattaaaagaatggtcactgaggaagtacagatgttgtacctacttgacaaagacattaaaacaactgtcttaaatatgctttaaaaagtaatggacaaagaatgaaaggaaatatgaaaaataatgtgttagccatattagaatatcaataaagatacaaaaattacaaaaaatagagccaaacagaaactgcatctgaaaatacaattactaaaatgaaaacgttattagagggctttaacagcagatttcaacaagcaagagaattagttcatctgaaaataggacaatttaaattgagtctgagaagcagatagaaaaaaataatgaagaaaagtaaaaagagcttaagggacatgtgggacaccatcaagtgggccaaaatatgcattttgagagtcccagagacagagaggaagtagaagaaagaataggtaaataaatactaaacaaaacttcccaaatttgatggtaggcatgaatctaaaagtccaagaatctcaaaaaactctcacaccaagacaaactggtcaaactgccgaaagaaaaagacaaagagagtcttgaaagtagcaagggagaagcaacttgtcatatacaatggaccttcaaaaagattaatagctgatttctcatcaacagaaaccataaggccagaagacatttggatgacatatttaaagtactgaaagaaaaagaagaagaaacaaaacccccaaatctgtcagccaagaatatcatgtctggtaaaactgtccttcaaaaatgagagagaaattaagactttcccagataggctgggtgcggtggctcacgcctgtaatcccagcactttgggaggccgaggtgggtggatcatgaggttaggagatcaagaccatcctggctaacttggtgaaaccctgtctctactaaaaaatagacaaaattagctaggtatggtggcgggcgccggtattcccagctacttgggaggctgtggcagaagaatggcgtgaacctgggaggtggagcttgcagtgagctgagatcgcaccactgcactccagcctggatgacagagcaagactccatctcaaaaaaaaaaaaaaaaaaaaagactttcycagataaacaaaagctgaggaagtttattgccagtatgtcctgccctcgccctctgagatatgttaaagggactccttcaggttgaaatgaaaaaacactagacattaaactaatgtcatatgaagaaataaagatcttcagtaatggtaagtacatgagaaaatataagagctagtattgttgtattttgtgtttataatttcattttttaatttcctgcatgatttaaaagatctaagtgttaaaaataactatatgtttattgtattatacacatataaacatgtaatatgggccaacaacaaagtgtgagaaatatggagtacttagaagcagaggttttaaatgttattgaagtcaagttggcatcaatttaagacagatgttataaatttaggatgttaatcaccatggtagtcactaacaaaatatctaaaaatatattcacaaaagggaataagaagaaaacaaaatggttcactacaaaaaaaagtcaactaaatacaaaagaaggcagtaatggaagaaatgagaaccataaaggtatgatgcatatagaaaaatgttggaatgtcaaaagttagttcctgtcagaattacattaaattcaaatggattaggttctctaaggcagcaattggcagaatgaaatttttttaaatgataactgtatgttgtctgcatgagactcactttagattcaaagacacaaacacattcaaagtgaagtgatgaaaaaggtatttcatgccaatagtaaccagaagagaaatgaagttgttattttaatatcagacaaaatataatttaagtcaaaaacttaaaaaatgaaaagaccattatatatcaattaaaggacattatatattgataaaagagagaagacacaaattcatcaaaaagatataacaattataaacatatatgcaccaaaaccctgagccccaaaatatatgaagcaaacattgacagaataaagtgagaaataaacagttctacaatagtagttgaaaacttcaatacaatacgttcaatgatgcttaacacttctagaaagaagatcaataaggagatagaggaattgaaccaccctatacaacgactagacctaacaagcatatatgtatgtgtgtgtatatatatacacacacatatatacatatatatacacatatacatatatacacacatatacatatatgtatacatatatacacatatacatatatgtatacatatatacatatatatacatatatatataaacatttcacccagcagcagtaaaatgcacattcttctcaagtgcacatgaaatgtcatccagcatgcaacctatttgtgattgaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatatatgtatacatatatacatatacacacatacatatatacatatatacatatacatatacatatatacatatacatatacacacatacatatatacatacatgtacatatatacatacacatatgtacatatatacatatatacatatgtacatatatacatatatacatatacatatgtacatatatacatacatgcacatatatacgtatacatatgcacata

SEQ ID NO: 17722 - DNA, 25751 bp, Homo sapiens
agacagagagaaagagagagacagagacagagagaaagagagagacagagacagagagaaagagagagacagagacagagagaaagagagagacagagacaaagagaaagagagagacagagaaagagaaacagaggggagggagtaagtccaggtaaaaaacaaacaaaaaaattgagaatagaacaagagagaaacagagacatggagacacagagaaagacacagtgagacacaggagacagagacagagagagatgctgagagacagacagggagagggagagagagaggagacaccaagacacaaagagggcggagagacagacacagaaagagggagacagcggggctggatggacgtgtggccgggccagtggggaggagagacgagtccgcagacagcgttcagaggccgcgctgcctgggtgctgagccgtcccggggttcacggtcgcagtttgtccttacaaaacgcccagccgccccgacctgtggtgcttagggaggacctacctggctgtgccggtctgagaaggggccagtgaggcccggtgcgggtacgggcgggtgcagatgcagccaggaggacgggcgggagcgggggcctgtcccacacgggggcctcggcagcaccggcatggctggaggccagtacggccaggtgtggcgggagggagcgccgtctggcttgggtcgtccatcctgacaggacgctgcaagggcaggagccccgcgccccgtgtcctgcgcccccgctcgaggacaagccccagccgccggtctccgctgggttccgacaggccttgctgggaggccttgctgggagctgggggtcgaggctcacagactgcgctgaccccagcaggcacagctgggtccagggactcgggaactcgcagcctgacgcgggccggacccccggggtgggtgctgagggcctcggatgccctccctggctggacgttgtggctgtgctgatactgagcggtaaccctaggaaggagagtcccctgggctcagctacccgggacaaggtcaacagggacaccggccccagttccaggagaaaaacaagcacggccagcggcgagtgtgggcgacagcagctcagggagaagcagattatcaacagcgaattcactcagggtcagccaactgtacgcttaaaaaaagattcctgcggtaaactgtatgtctattttaccacaataaaaaacttattgtttttaattaccaatgacttctaaaaaatgtttttaaaacccagatcacaaatcctgaacatagggcctgaaaggcgaattcagccaccacggaggactcccgcacggtggagccgggacgcagggactccatgctgcgcggagggcaggggcacgtgacgcagggcgtgggggaggcggggcgtggaggaggcggggcgcggggggcggggcgtgggggaggcggggcgtgggggcggggcgtggggggcggggcgtgggggagggcaggggcacgtgacgcagggcgtgggggaggcggggcgcgggggaggcggggcgcgggggaggaggggcgtgggggggcgggccgtgggggaggaggggcgtgggggggcgggccgtgggggaggaggggcgtggggggcggggcgtcggggagggcaggggcacgtgacgcagggcgcgggggaggcggggcgcgggggaggcggggcgcgggggaggcggggcgcgggggaggcggggcgcgggggaggcggggcgcgggggaggcggggcgcgggggaggaggaggaagggttctgagtggacgcggggactccatgccacgcggagggcagccgctcatgaggcggggtgtgggggaggaggaggaagggttctggagtggcttttctactccagaagtctccccgatcctgaaagaaaatctagacaggtggaaaaaagagaaacatgtccagatagtgtcttccacattaatggtctcccaagctctgaggaagcccaatgagttgaacagtttctcataagcttgcgggtccctgtcagtgcttctgagatgctaaaaacgccaggctgtgggctgcgtcaccatgtgtctcctctttaatttcttcaggagctccaggtgataagctgccacctccatccacaatgtggacatcagaggatgcagcatgctgtggtttgaatgtgtccctatagtgcacgtgttggaaacttaatcccaaggcaacagtgttgagaggtgggacctttaagacgcattcattgtcagagcccacgtgaatgaattgataccactattgtaggagtgggttcgttattttggaataaaaggatgagtttggcccccttcctctctcccctttctctctctctctctctctctctctctctcacgcgcatccaccttccaccatgggatgacgcagcaagaaggccctcgccagatgggggcccctggacctttgatgtcccagcctccagaactgtaagaaataaatttctgttctttataaattacccagtctcagatatcctgttacagcaccacaaagtggactagaccacactctactctgtgaatctaagacgcaccattattgatgaacctgaaagaaagagcatatacccaaattagctgtgggtcagctcagcctggaggcaagagggggaagctcagataatctaaaccacaggccagccaggaaccagctttgcaatacatttacactattcacatgggctcccaaaactcacacaaaaaaatgtatttaaagggattgcaaagtggcagtgcccccagggggcaacataaagcacaacccctttcaggaagaactcggccttgtccaggctgacattagaacattggctgtagggaacaggccaattcagagatgttgaaatctaaaacataggtcccagagttgattgaacaggtatttaaatagggactgcggcaagatctaagtattcaatgaccaggttctccataggctgctcatttcaggttccacacaaagttgtggggtcagttgatttaagctggggacccccacagaggacaccccaacatctgaaggacacgacaaagaccccaaaggaaggaagattctcctcaggtatacagaaggaaagtaaaccagtcaatggaaaaagtgtcccaatgttggttggtttgtttttcagaacagaagagggtgacagaagaacgattattcatatgagagatgaggaagatgagcagaacgaggtgaatcttaatgtttggacaatttattattgtagaatttttggtccaaaggtggtatctttgagaaggcagatgagaaaattaaatcaccacatacaacacggtcagtccacgtacaacacagtcaatcacagctgtggcctcgatgttgatgccttcctgtattagtctgttctcatgtcactgtgaagaaatacttgagactaggtaatttataaagaaaagcggtttaatgaactcacagttccacatggctggggaggcctcaggaaacataatcatggcaagcaggcacctcttcacagggtggcaggagagagaaaatgtgtgtcaatcacagggggaagycccttataaaatcattagctcttgtgagaatgcactcactatcacaagaaccacctccatgattcaatcacctccacctggtcctgcccttgacctgtggggattattacaattcaaggtgagatttggttggggacacagagccaaaccatcccccaaaactcacgttgaaacctaaccccctgtgcaatagtactaggaggtggggcctctgggaggcactctgccttcatggatggatgactgccctcccaaaagaggctccagggagcacccacattcctcccttccaccatccaaggacacgtctatgaatcatgggccgtcaccagacactgagtctactggagccttgatcttggacttcccatcctccagaactgtgagcactacgtttctgtttatcgtaaattacccactctaaggtgttttgttacagcagccccaacagactaaaatggtccatgagggaagaggttgtagctcagatacccatgtcaggcatataggatgtgcttaattaacacttattgatcgaatgtgtatgtccctgtctgcctttccatttttaggcagctattgatggtttttaaactatccagcagaagtatttttaatgtaaatttccatgtgggaatacattttcacacaaaaaaaggcaccttttcttaagtgaaggccacgtagattgccaggctggtgcaattcacccaagagctatcctatacaatcaacttctggctttcaaattattttaactcactcactaaagataaactttattttcttttcccagctttttaaagcaaacttcacaacttcagtgtatttgcgggcatgccctcttaatcaagggtgtcagcttcttagttttcttctgttcccactttaacaaaattgtatttagaatcctttcattgagttttgccacctttgagtgtcattcaatcgaacaatatctatatgctgacaatgctgtcatttcatctgttaccacctgaatctccactgtgagtcccagcttctcggatgcccactcctgtctccacctggacatcccacagacacctcaaatttgccaaacctcgcttccctctgccctcctggagcttggccgtctcagcacacgcactgccatcctcccaatcgctcagcccaaaccttggagccgtgctgcccgacacaattcatcatgaatcccatcagctttcccttcctgaagcatccagactgcaaacgtgcttcctgctgcatggctgcaccctcaccccctcctggactagccggcagcctcccttttgacttctctggaatgttctgttctccacacagcagcccagtgatcccttcagagcacaaatctttccatgtcaattcctgttccctccaatatcttcccaacacagtgaaaatgaaacaccaggttcttacctcaggcttcaagggctgatatggtttggctgtgtccccaccgaaatcttatcttgaattgtaatccccatagtccccacgtgtcctgggagggacccggtgggaggtaattgaatcatgggggtggtttccaccatgctgttcttgggatagtgagtgagtctcaagagatttgatggttttataaggatctggcatttcccctgcttcagtcattctctctgctgccaccctgtgaagaggtgccttctgccataattataagtttcctgaggcctccccagccatgtggaactgggagtcaactaaacctcttttcttaaattacccagtcttggctatttcttcataacagtgtaagaagggactaatacacagggcctacatctgaaagcagcaaacgacaaccctggggccaaatctggccccttaatagctcttataaataaagctttattggcacacagccaagtgttcattcatgattgtctatgctgcctctgctacaatggtgctgagctgtagtgacagacactatttggcccttccccgctttctccctcctccctccctcccttccttttctccccttccttctttccatcctcctgctttccctccctcactccctcctgtctctttccctcgttcttttctgtgtattccacacacacctagaacgtaagctgcatgtgactttgtctgtcccgcccagtgctgtgtccccagggcctatctcacctccattgaccacacacgggcatgggtgccaccttccaccttgcacctgctgcctttaccttctgttctctgtctccctaaatatctcccagggtcctctgagccttcaccgttcatttctctgcctggcctcaaacagaaaacgtcaggagggaagcacacagctgcacaggtcgtgccccgaggctcctgctgccggcacctcccccagcctggactttggctgtgtttgtagccctgtcccagcrctccgggtgggaatggcaggctgcgtcccactgctccagggcctggtcctggtcctcgccctccatcgtgtggagccctcaggtaggcatctggcttacctrtctgttgtgcctgtgctgtgtctttcttgactcggtccatggtggatttgtagatgaggctttttccaggagccagaggagccctgagtgcccagactagtcttaattcccctgaaaaagctgtttggatctttatcatttggtgacaagtatttgggacatgatagtgtcacttggggtcctcccaagagatgcccaaatggraagaagcctgtgtgcaggggattcagccgggaaaggccggggagaggggagggggaaagggggaggagtggggggaggcctgggttgggcattggacgaggggagggggtggggcaggctgagcccagactgcaatgtgggcagagagagccttggccaggccagccaggaatgcccagtcttgagtcaggagacatagccagggagcagccaccctgcctgcctgccacccttctaccaccagccacttcactgaaggaacgacatggactccattctgactctgcctgcacaggcgtccaggaaagctgcaagtcaaaacacccagcatccccgctggccccatggtctcccgctggccccatggtctcccaccctgagagggtgatccccccgccctgccctgcccagcacttaccgtagccggacttagctgagccccccctgctgtaaccctcagcaccgagagaaaaggagggaggatgggaagggcctgggctttgaccctcccggagagggagagaacatgctttgggaccctcaggtgggaagaggctccagagaccactgccgcgggtcaactcatttgccttctcctcctggaaatcgcagagcctgctgcaatgtataagtttcttctttatgtgttttatcaagatgttaaatgctgcgcacagaggcagcacaggagctgatggctcttggtccccagttctcagtacggggacctttgaccccagctcagccttccttcgcactcagacccaaaacccagttggagccctccctcctccactttcctgactgaggcccgtggcctctctgcagaaccttagtgtatccgcactgatcctggggctgatccattcgcccagaggatgaagtgcttgcctacctcgggggagggagtagcggggtggccctgaggccctcgcaggctgagagcctgtggagacrgacggggctggggctggcggccggccggggaggaagccaggcagctctggaaagcagggccctcggtgctcccagtcacctgccttcttgtctcgtctgtagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagaraagtgtttgaaaatgaagtagtcactgtatgtacccccaccacaaaccacaggcctcctcattatttagacttctgctggcccagggagcatcatttctcagagattaagcttaattaattagcctatttacttaccgatgaggttgacacaatcccagttttacagatgaggaaacaatttagagaatcgacttaatccacctttccctacagcagtgagtggggctggaagtcagctcagagcccactggactcatttcttcaggtcaggcaaggcccacacactgatcagacacccagcatacattttctttctaggcttcaagtctgaataattctcctaattttagatactcctaccccaaactaagygtccccactccctacagaggtatatatctttaaaattcaactcggtttataaaaagcgaaaaggtgatgtgacttctatatcatgtgcttttgtggagggtggcgtggagattggccctagaagggaagggccacgttaggggctgtgggtggtgggtttgtgccatgtcatagactctggccttcctcaaataggtggtggtaagcacatgttgagtaatatatcttacagatacatttagttactatacatttaacataaacaaataggctgtaaaacaggaaaattgtgcattgtttcaaccactattgtcctattaagtgaataaaatcaacattttcttaccttcaagttcatctayaggaaagaatatagaaaaacaaatatcccatttgtaacatttttatgttttaactctaaaggatgaattctggagacgatayaagggtaagtggtttccttcgtctcctcagaagtattaattcctcgggatgaggtgcgtgggtgggcttaggacgcttcacgaccccagctcagcggatgccaagcctctggctccaggacccacggtgtctctccagggaagggcagctccgactctccccaaggaccaggtcaggaagcccccgggctctgccaccagggccacaggcagtgcctggtttgtcttgcccagtgtctgggtagtttcttggcactctgggacatgggccacaggccaggagggcccccccagagcagctcctccagccgcctggctcctgggctcctgggaagcctcatgctgcagcagggtcagaactcgtctcaaattttggaaagtcatggccccgatggagactttggttaggagactcctcccaagggaggagctctaggtgggcaactgcagaagagcatgggacagaagtaacacagatggagacccacggggctgggggaggccagggtaaggacccacctgggaatgagtaagcaaagagctgcagccaccaccagacaagcacggggacaactgggcacagaaggaagcgggagaggcagggaaggccggagaagggctgatggggcgggacagaggggaccgcgtgcggacgaagaaagggcacccagcagagtgggaggcactggcagccaggccttacatccggagcggggagcgtcctgggggccaggcgatggcatggggagcagcatgagcaggctcagtccccattcctgccaccccctgcccccccgtcctcctcctgctcaggtccccgtccctgccacctcctcacatcctcctcctgctcaggtccccgtccctgccacgtccccccatcctcctcctgctcaggtccccgtccctgccacgtccccacatcctcctcctgctcaggtccccgtccctgccacctccccccatcctcctcctgctcaggtccccgtccctgccacctccccacatcctcctcctgctcaggtcctcgtccctgccacctcctcacatcctcctcctgctcaggtccccgtccctgccacgtccccacatcctcctcctgctcaggtcctcgtccctgccacctccccccatcctcctcctgctcaggtccccgtccctgccacgtccccacatcctcctcctgctcaggtccccgtccctgccacgtccccacatcctcctcctgctcaggtccccgtccctgccacgtccccccatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacgtcccctcatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacctccccacatcctcctcctgctcaggtccccgtccctgccacgtcccctcatcctcctcctgctcaggtccccgtccctgccacctcctcacatcctcctcctgctcaggtccccgtccctgccacctccccacatcctcctcctgctcaggtccccgtccctgccacctccccacatcctcctcctgctcaggtccccgtccctgccacgtccccccatcctcctcctgctcaggtccccgtccctgctccactctgtcctcctcctgctctggtccctgttcctgtcaccccaccctcctcctgctcaggtgctcaggtccccgtccctgctgccaccccccactccatcctcctcctgctcaggtccccattcctgtcaccacccccaccctcctcctgctcaggtccccgttcctgtcaccaccaccccaacccccatcctcctcctgcaggcggctccccgtgcatctcccagccctgcctccacaacggctcttgccaggacagcatctggggctacacctgcacctgctcccccggctatgagggcagcaactgcgagctgggtgaggccccggccgtccccttcccccaagggcctccctgggcaggtgggcctcacatcctcggccagagtcccaatgggcccctcctgaggtgtagccatgaaggtgcctgtgtgaaccgcgatttggctcaccccaggggattcctctcatcccaaccagattctcctccagaaaccacgccgggggctggctgcattctgagctgccccttccagacaggcccccatacttttcatagcaggggcccctctcctccccccmccacctcaaccattcacaatctgctcacaggctgggggggtcacacacaggcgtcctcagtgccagactcccagtgggagactgcagacagggaagacgcaaagcacgtaaacaaatatccttaaatacccgccaaatgtcagtgtccatcatcgccaactacagcaacaagcgtgctccgctctcagcaccactggtcaacttggagcccgtttctctggggaaaaccttcctcccagccgagccctctcctccgaagtccagatttctgctccatctgcctccttgatgccccagctaatgccttcacagacaccccaaatttaccacgtaccaaagggggctttgaccttcacccaccatgtgcccctttcttaatcttctccctcttggtggaaagcccccatcccagctgctcagccaccaccgatgtcacactaaccccctcccatcccacgtcccctccttgaagaagcagcaatttaaagggaatagccaatgcaagccggcagacaaaacaggcgcgtggattagtccatgtggaaaaaggacaaatagaagtgtcatcactcatggagtctttttttttttttaatttttattttatttttgagatggagtctcgctctgtcgccaggctggagtgcagtgacgcgatgtcagctcactgcaaccttttgcctcctgggttcaagtgattctcctgcctcagcctcccgagtaactgggactacaggcacgcgccaccacgcctggctaatttttgtatttttagtagagatggggtttcaccatgttggccaggctggtcttgatctcctgacctcgtgatccgcccacctcggcctccyaaagtgctgggattacaggcatgagccaccgcgcccggcctcactcacggagtctttgttctacatgcacattcctgaaatacggacatgtgggaaacactgacacagaggacaacgatctgaagagaatgagaacacatggaccaacacaccagawctcttgtgtgcaaggctgtgataaaatgaacatggaccaacacacagaactgtgtgcaaggctgtgataaaatgactatttccaagctagcatttccttttttttttttcccttttcagctaaaaatgaatgtcacccagagcggactgatgggtgtcaacacttctgcctcccaggacaggaatcctacacgtgcagctgtgctcagggctacaggcttggtgaggaccacaaacagtgtgtgccccacggtgagtgctcagaccacagcggcctccagcttccaatgccagcgaccccgtccacatcctccttccttctgtagtactgggtgaagcccgcggatttgtgataagcagttgccacgactcagaaggtggtccgcgtctccacgctggagcaatggccatgctagaaagtgcagtttctgtcactagtgcttgctcggaccactctgagctaaaccatgagtgctgtgaggggtggtttaactccagtctgtgtgtctgtgaattactgcacattcatcagcattaaggataagattataatggttagtaccatagacggaattatgcaacggttaacaccatagacagagtccgatattcgctgagaaggcgctgatttttattctcatgttgctgccgcaaatgcagaccagtgtgcctgcggggtgctgacctctgagaagcgtgcaccggatctacaggacctcccgtggcaggtaacagagcgctctccgcgtgcttcaatttattgttatgactttcacctcacttgtcatttcctaaatagaaatgttracaactaagtgaatcaggcatcctgactttgatgggctactgactgcactgaccaacctctattcacacttccaaccatgttctaatgccgagttcataactaatacaaaaggacagcattatttacagcccccaagacctttcctctgcagttccaaactgttaccaatgtcattttctcagaacataagcatctcaaaatctctgctctcggctgctggcctggcattctagctttgttactttgttcactaaatttctctagtttggcattcatttttgttctccttttcccctccttggctggtttagaagttaaccattcatttgtttttggtttgttttttttgagatggagtctcaatctgtcacccagcctggagtgcagtggtccagtcccrgctcacwgcaacctctgcctcctgggcacaagcrctttccctgcctccacctcctgagtagctgggattacaggaatgtgccaccacgcccggctgatttttatatttttagtagagacggggtttcaccatgttggacaggatggtctcgaatgcctgacctcaagtgacccacctgccttggcctcccaaagtgctgggattacaggcgtgagccaccaygcctggcctcatcattcactttctgtttacttaatggtcactcttgacacataaacatccatatttagcacaagtagtcagctatttctccctcctcaggctaattcccagcacctcattctgggtccatttgctgtctggccagtattttattcttttcttgctttctgtatatcttcacaaaatagatattacgatttttgttattatggttttataccacccacactggctttgatttacttacctcattttccactttccttgcctttcaggcctctaacacaattatctcctgcctgagtatatccttcagaacagccttgtccaatagaaatgcagtgtaaaccacataatttaaaattttctagtagccacaataatgtaagtaaaagcatgtgaaatttggatatttaacccaatatgtgtcattatttccccatgtaatgaatataaacattattgaggttatttgcctttttcctttacactgaatctttggaatctggtgtgaatttacactgaggtgcagccctcgtgtccmcaatgctccgtacccgagtgtggctgccgtgtggatggcacagcctcaggggccccccttgtgagtaataagcccctgaggtttctgtgtgtgacacccgtcagtttcacccgactcttacaagacagctgtgcccagcccactcattctggcagttgtgtggactggcagagaacaggatggagctcaaggacttgaagccacccagctccaaggtggagaggaagaaaccgaagggaggcaaagcagacggagtgatggaaggcggggatggaagcgggaatggtctatcaccagctttgcaaacttcctctcaatcttttatcacttttcctgcccaagctttctaagacagttcttcctatcgctgtctgccccatgagtgcgctgagggtcggtacttgggaggcccagagtgcagtggtcctccataggtagtgacagggtctggctctaccacctgcaggctgtctccagcttcccagcttacccaagggaagagagggcgcggttctagtctgcaaccgtagcactcataccagcaaggctaagagccatataaccagggaggaggcattctctaaacacagctggtgtgtttaagacagaggacactgacttaggcaggctacatactattagattttttacttcagtattataaattgttctgaagttatttaactgaatatatggaattttcctaaaacaaactttgaaaaggagaataattaagtgacctagcaggayatagggttgaagattatctttagaacttccttgtttcttacatcctmgggaagaagtatcactaaaagtctggcagactgatggcgcaagtgccgtcttctctcgaacttggttttatcccctttaaagtgaggatctcacccctagaggtgcagtgaggattacagrtaacgttcttgacttatggtaggtattcaacaagtggcagctattattcataaacacatgaagagttccaggaacgacgccacggtaaagttggaaaaacactttctcacttggctcagcattttgcattagacggttgaaaactgcaacacttaacacttccagagccagtacccgtrctatgtgggsacatgctttatttcatttaatctttcaaacaacttctcgttttctccttttgtatccctggtaatattatttgctctaaaatcccctttgtctgatattgatatagacactttactttctaattattagtgttagcatgacttatctttttccaatcttctacttttagcctatttgtatttttataaagtgcatgtttaaaaaataaataaggtacatgttttataggtagtatataattggctttcatttttatccagtgtgaaaaacctctgccttttaattggggtatttaggccattttacatttattgtaattgtcgatatgtttacggttaaagctatcatcttgctatcttttatttttcttatctgttcttttcccctttttctgccttctgttagattaactatatattgttatgattctgttttctctcctttgttggtttatcatctctggttctttgttggcggttgcttcacagtttggagaatgcatctttaccctatcacagtccactccactttcgccgacgccacatccgctcgctgtagcatgagtccttacagcaatcatgccccattcctcccctcctgacctgggtgctggttttggcataggtcttacatctacagatgttataaatgccactctatacttccattatttttgtttaaacagtatcctgtraagaagtttaaagaataaggaaaaaaaccttacatatatagtggaatgyggataaatatttaatgggatgtcataaccttttccagtgttccttgctgctttgtgtaratccaggcctccctctggtatcgttttcctcctgcctaaagggcccctttgatatctgctgtgctgtgaggcgtctggggaagaagccttcttgcgtttgtctggaggagtctttgttcatcttcatctatgaaaggcattgcgtctggcgcagagccccaggctggcagcagtcctctcctctctgcacttgggcctgccccactgccttcctgtctgccttgtgccacaagacggctcccatcaccctgctgctgttcctcacatgtccttacctgtggcacttttaagattttaaatgctttttaattttaactttctaagatttcctctatcatggattttgaatttaattatactstgtattgttttcatgtttcttgcacatagggtttgttgagattcttgtatttgtgggctaatatcgcttgtcaaatttgaaaaatatttggtcataattttcttttttttgagaccgggtctcgccctattgcctgggctggagtgtagtggtgtgatcatggctcactgcagcctcaacctcctgggttcaggtgatcctcccacctcagcgtcttgagtagctgggaccatagktgtgcacgaccacacacagctaatttttaaatttcatgtagagatggggtcttgctatgttgctcaggctggtctcaaactcctgggctcaagcaatccttccacctcagcctcccaaagtgctgggattataggcgtgagccaccatgcctggcccattattttcagattttttttctctcctccttctccctgctctgttttgggactctaattacatgtatcttaagctgtttgaaatcccatagctcagagatggtctgttcatttttcaaaaatctccgttctctccgtgttttacttttgatagtttctgttgtgatgccttcaaggtcatcaatctgttcttctgcaatgtctaatctgccattcatcctggccagtggatgtttaacctcatatattgtagctgtcatccaaaaatttaatttaggtttttaaaaatacgtatttttgtctctacttaactttttgaacatttggactacagttacaatcactgtttaattgtccttgtctactaatatctgtcagtgctgactcagttttgggatatttttcttctcattatgggtcacattttcctgtttgtatgccgtaatggatttccagacatgtgaattttatcctgttaggtgctgaatattttgtgctctatacatacacttggatattgtcctaggacacagttaggttggaaatactttcatcctttggcacattgctcttaagatttgtcagtaggaccagggcagcgctcaagtctagagctagttattctgactactgaagtgaaacccttctatgcatcctgccccgtgccccactgagtcagggatgttttaactcagctggtggaagcaattgctattcccagcttgtgtgagtgtctagcacaggtccstctcacactcttgggtggttcttacccggccataattagtctccaygtacacgtgatcaccactgctctgctgaaaactgctaggcatgtggccatcctccagcattctctaccaagctctctcctctgccggactctgttctgcaggactctgttctgcaaactccagccactgyggcctccctgggctctcagctttctctcttcaatttagggagtcagcrgggctccaactgagatgccccgtcctgctctgcaccatggaaattctggacagtagctgagaccgttgtttcttggggattacgattcctgaaaaccatcattccatagattttgtcaattttttgcttcaggtgggagggtaaatctgatcactgttacttcacctgggccgaaaggggaagtgccggccccatttaatccctaagcaaacaaaagcttagactgtcaacaattcgttaacaatcctgtaccatttgagtgctggggcaagaatcaaatacggctgtctgcctttggcggggggtgggggtgggggtgggggggtggtccatatccctatccagtagactttactgcccctaatcctgcaaattgtcaccagctatttattgtctgttttgatttttaaaggtaaagttaacaaattccgaaggaaaagacttctgtggtggtgttataatacgggaaaattttgtactgacaacagcaaaatgttcactgttacacaggaatattactgtaaaaacatgtaagtattttatcatgagtttttataaaaccacattggaaatacactatcctatgtaagaatgaaatgacaaatttaaaactggactgtttctaatgcaacatagaactgaatttactgtcaataaaactgagatacttatcaactcaggaagcatatgtaaaataccagcagaagcctgggcccagcgacaggcaagtgctaactcacactcggcaagggaggaaatcacagcctacataaggatgacttcatttcccactgaaattgagcagttgtggcataagagatggataattggctaaaaatcggaagaatggggctcgaatsccccagcagttgagacctcaggctgaggcagtggccttctcatcggcttatctgtgcctatttctttcttttttttttttgagacagagtctcactcaatccctcaggctggagtgcagtggcatgatccaggctcactgcaacctctgcctcctgggttcaagcgattctcatgcctcagcctcccgagtagctgggactacaggcatgcaccaccatatcccactaattttttgtatttttagtagaaatggggttttgctatgttggaaaagctggtctttactcctggccttaagtgatcgacctgcctcggcctcccgaagcgctgggattacagatgtgagccactgtgcctggcccttaaatatttttcaatcaacaaaataacgtgaaaaccacttctcaacagccaatgtttgactgkcctggagacgttccacatcactgcttcctgctttttaatcatttcaccacaccccactgcactccaaaacagaagaactaaccttgactgtttttaaaggctgtggcacttggttgcaatcgtgcaatctgtgagtggcctttctgtccgcagaaaggcacagtgtccacaccacggggcggtgagcctgcgggtcctccagggccggtctctccctcctcacgtggctccctgagaagctcgtttgagcattatgtccccttgaaaatcagactgtaaagaactgacgattgttcatgatttcagattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacrcaccaggggcctcctcagyggctgggcacgcaatggcactgacctgggcaactcgctgaccacrcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaacyggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcataaagcagcctggtttccagaaattctttccttctccaagtccagtgttccctgtgctcagggaatagccaccccagcctgcacactggtgagtgtgttctggtgcagaagcgacaacaatctccggttacagcagaaagtgacctcctctgttggtttaccaattgccactgtgactgaggaccatggctcagtgcagaagcagccactagaagcaggttggcaatggaggagaatgaccctgtgggtatcccagagaggcagcattagaggaaagggccagagagcacaagagaggctgaggaggcacgccggcgtctcacggggttgtgcacccgcccttctctgggagggttcccacggaaggttccggggcccgaartcagggctgagcactgagacccagctctctgctcgtcccaccaggtggctcttggacaactgttccacctcttcatgcctcagggtcgcccagggtagaatcccagcacctcaccaatgggctgatgggcagctagggcaacgcccagcactgttgtggctggagtgtgtgtcccttcaaaactccaaaattggaacttaccccaagatgatgatatggggaggtggggcccttgggaggtgactaggccatgagggctctgccagccccttccatctcttctcccatacgaggacactgcagtgaggtgctaccctggagacagagagccctcagcagacaccaaatctgccggcacccagatcttgaacttcccagcccccagatctgtgagaaatgagtttctgttatcacccagtccatggtattttgtagaacagaccaggacagcacgtgctgaatcacagtaaacacctgctgtcatgaaggctgcagctgcaatgcaagtaccaaagacagagctgcagtccagcccccagtgaaacgtccttggagactggagctcctagcagggtctgaatttgcactgaaatggacagaaatggcataaatgttcacattttaactctgacttagttaaggaaggggcacagctgcttctccaccagtgtccttgagtgacacagagcagagcatcgttgaagagcagagaggacttttaaaaagaggaattaaaaatgtaggtggacaaatattctcttgagttgagaacaatttacacataacttgggtttttaagccttactgttcttcagcacactctctttcatttacgctttaaccccagaattaaacttttctccaacctgtagatgaaatggcccatttctctgaaaggtccttggcaaaaagcaacactgtaatttaaggcaaattaatggggagggcagtttaaaattcactagggtgaattttaaagtcttagtgaagtttggttgtattattctcaaactacaataaggtaagtaagtcactgctttaaatgcctactaatgattttaaaatcagctaatgaacatggcaggctttctgtacataatgctgcagaaatgtctgcaatcttgcttctggtacttctattacaaatttggatttactagagtggaagccctgcttgaaaactattccagtccaggcgcagtagctcacgcccgtaatcccagcactttgggaggctgaggcgggcggatcacgaggtcaggagttcgagaccagcctgaccaacatggtgaaactccatctctactaaaaatacaaaaaaaaaaaaaatctttgccaagtgtggtggctcacgcctgtaatcccagctactgaggaggctgaggcaggagaatcacttgaacccgggaggcagaggttgcagtaaaccgagatcatgccactgcactccagcctgggcaacagggcgagactccatctcaaaaaaaaaaaaaaacctacttcaaacacagctgggcagaggcaaagcatatgaagaccctccctccgtaatggtgaaatctgtgaaatcaggaacaatcagagaaagctacaggcccagactgtcagcagagacatgaggggccttcaaaatgaagtaactactctactggcatttaatgacatgcttagaaactacaccataaacaaatctaacaaaacagtaaaactcaagaaaagggaagctagctatgatgactgtttttcttgttttttgagacagggtctctgtctgccacccaaggctggagtgcagggcacgatcctagctcatagtgggctcaacttcctgggctcaattgaccctcccacctcagcctcctgactacaggtgtggaccaccatgcccagctaatttttgtattttctgcagagatggattttgccatattgcccaggctggtctcgaactccagggctcaagcaatctactggcctcagcctcccaaagtgctggtatcataaatgtgagccaccacatccagcctgtgatgatgttttaaaagggccaaactagttcacacttgggcagagattattaagtccaatatttgaatccatgcaaacacactgatacatgcccatgtgtacgcccgtggacttgaatgctgccatgctggacacaggccttgactttgcgtctccacccaaattccatcttgaattgtaatccccacgtgtggagaagtgattggatcacgggggcggctcccccacgctgttctcgtgacagtgagggcgtctaacgagagctgatggttttaaaagtggcagttttgctcatgctcacttccccttccgccatgattgtaagtttcctgaggtcccccgagtcatgtggaactgtgagtccattaaacctctttcctttacatattacccagtctcgggcagttctttatagcagcgtgagaacgaactgacagaggcctgaacaccaagaggtaaacgtaaggacacctacactgaggttgtttctttcatcgctaagaataaccatccaattaccttaaagtatcaatccttgactttaggtgtcactatggacggttcaatacgttacccagaaatgttgacaaacctgagctttccaccgctattacatccagaatgaaattcaggtatgctggcagaaattccaatattcaaattactgcaagaaaatcatttaaatcaaaagttgaaggatgttcaaggcccatgcagagcagcagggaagatcagatttccgtacccaacactgcaagagaacggggccccactggacacatgggtagctagaaaacagatgcgcgcccaaagcctccgccggcatgagtttgctccgtgtctgccccacaggacataggaggcacttgtcacgactgccagcgctgaggaccttgctgctgctggggagcagctacgtaggtcaagaggatccttggcatgaactccacaggcacaggcgcttgccttcgtgcattcatctctcgcgtgtacgtgtggcagtccacggctggaatccgggtgtgacttaggagagcagggcataaaagagatctggcttccctggctctactgggatctgcgctcccagaatccagctccctacgtgtggagagaaacaggggagcccacccacagccctgctgagctccaggtgagagcccgggccaatacacgggaatgagtcaccttcaaagaggcccattcgggccccagaagagcccacaagcttccccgcccagcccggaagaaactgcagacctgcagatgtaggagcgagctaaggagtgctgctgaagccctggggcagctcctgcatccaggggaacctgaggaaggagccacacaaagtgagtcctgygccgcgcggcccggagagagagaaagagggattcacactttgtagaatagcctctccttgaacaagcagctttcaaatgcagtaactttgcaaagatgagctcttatggtttgtgttcttctttagtaaattttttataaacggggaaatgtgcatactctgaaaaatggcagtgctggggactaaactgtgtcccccaaatttcttacattgaagtcctagccccagtgtgactgtatctggaggtaaggtcttcagggggtaactaaggctaaatgtggtcataagggtggggtcctaacccgacagaactgtggccttgtaagaggaagagagccgggtgtggtggcacatgcctgtcactcagcactttgggaggccgaggcgggggaattgccccgacagaactgtggccttgtaagaggaagagagccgggtgtggtggcacatgcctgtcaccccagcactttgggaggccgaggcgggggaattgccccgacagaactgtggccttgtaagaggaagagagccgggtgtggtggcacatgcctgtcacccagcactttgggaggctgaggcgggggaattgccccgacagaactgtggccttgtaagaggaagagagccgggtgtggtggcacatgcctgtcacccagcactttgggaggccgaggcgggggaattgccccgacagaactgtggccttgtaagaggaagagagccgggtgtggtggcacatgcctgtcaccccagcactttgggaggccgaggcgggggaattgccccgacagaactgtggccttgtaagaggaagagagccgggtgtggtggcacatgcctgtcacccagcactttgggaggccgaggcgggggaattgccccgacagaactgtggccttgtaagaggaagagagccgggtgtggtggcacatgcctgtcacccagcactttgggaggccgaggcgggggaattgctttagcccaggcgttccagaccagcctgtgcaatattagcaagaccctgtctctacaaaaaataaaaaaattagttgggtgtggtggcatgcacctgtgctcccagctacttgggaggctgaggagggaagatcacttgagtctcggaggtcgaggctgcagtaagcactgactgcactgccgcactccagcctgggtgacagagtgaggtcctgtctcaaaaaaggagggagagagtcatctctatctgtaccatctctagcacagcaaggaataccaccttattcttaagtgtgcaactcagaagagagccctccccagaagccgaccgtgctggcaaccccatctcagtcagacctccagcctctagaactgtgaggaaatacattcctgttgcttaagctgcctgtggtattctgtgatggcagccccaacagcccaatgtgagtggcccaacttagcgactgtcaacctcgccgtggtgccgaagggacgcgctcaggggcagccatgcctcagcgtccacgcagcccttcagtttccactctcagtgtagcactcggtaagctacacgaggtatttacacttttatttttatttatttatttttttgagacagagtttcgctcttgttgcccaggctggagtgcaatggcatgatctcggctcactgcaacctttgcctcccgggttcaagcgattctcctgcctcagcctcctgagtagctggaattacaggtatgcgccaccacgcccggctaattttgtatttttagtagagacggggtttctccatgttggtcaggctggtctccaactctcaatctcaggtgatctgcctgccttggcctctgaaagtgctgggattacaggcgtgagccwccacgcccggcatctacactttattataaaataaaatcggctttgtgtttgattttgcctaagagtggaggcttctgagtatgttaaggaaggctagagtgagccataatgtttagtagcaggtgtattaaatgtattttcaatttaagatggttttttaaaagaaatttttttttaaccaacaaagcaaaggcaaataaaataagtttattgggatgtaaccccatcataaattgaggagcatccatacaggcaagctataaaatctggaaaatttaaatcaaattaaattctgcttttaaaaaggtgccttaagttaaccaagcattttgataacacattcaaatttaatatataaaaatagatgtatcctgg

SEQ ID NO: 17723 - DNA, 260549 bp, Homo sapiens
gcattgctgaattagtttcccatgagaaagtcttcactgaagaaaaattaattgcacgccttcaatctcagttgatataaaagtggccaattagacagagattctgcaatttctggaaaaaattaaaaaaaaaaaaaaaaacagatctgaaagcattgtccattatatgactcaaggcctcttctcaaataaaccacaagatacatttgtcctggaattaagcagaaggggttatcaaacgtttcattttccactcaacaaaacactgcaacatgtactgaatgaagagaacgcccaccatggcccatttctgatttctctcaaagcttcctcttccaggggattatcgagatactttcctgattaaaatttaaaacaatagcaagattaaaggtggattagaggcaggccagccaaacagctaagaatgtgaactttggagagagatagccttggttcaaatgtgtcatggaatctcaccaactttttaaaaatctcagtattttcagcttcatttttttaatctgaaaaattgaagaaaataagaaacattacagattataatttgaggattaaatgaatgtaaaattaaatatatgtaaccaatcagaatagtgtctgtcacactaaatcatagctaattattattactaaaggaataataaatgaaatttataaaataatatgcctttttacaatttttttaaagcatgcaatgtaaattagtggtcttcatctttaattaaaattctatgcataagaaatgccttgggcacctgagactaacaaaatagggcaccttggcatgagtcaaaggaccagggttgcaatgcagacgtttctgtgttagtttcctagtcttaaacctgcaggaagcttaagagagaaccctagttgattctaagccaaccactattggacacaaaaatttcaaaaacatacagaggaaaacatcctgaggtcaccgtcttcacttctagcctcagaggtccctgactcccaaccccctacctccagctcaggcaaacaatctgatcaccagctttctttctgtgcagctctaaactcagaacagcaataagtaaatcaccgtattaatttttgtttccgaaggatcttggagattctcaaaactactctgggctgtgggtaaatttatttttcatatgatttaagaaggcagaaggacagatagaaactgctgggcaattcagataaactgggttcagacttacctcctagtcttgtgaagttaaaaacttagtacagggtccaacacatagtgggtgcttaatatgagggagttattatgactgctggtgtaattattacaattgtcaactctagtatatatgttaaattaatacaactaaactactgttggggggaagtaaagaagttaatgtttatccaacaccactgacatatgtactcatcactgtgcaacatgatatccacgtcttatttaatcttccagataaccccaagaaatccataaaaaggggaaatgaaaaatgagattcaaaaggttaagtgatttttcctatccccttgagctagtacacagagtgctagatttggattggctgagctctccattatttatttagtctctccagttcagtgttgtttttttttctcctgtaaaatgggatgattattagatctcttctgtaagtttgttataaggattagatgagatcgttccaataaaaagcacttacatattgcgtggaacaccatgcatactcaatcaacgtaagctgttattgtaattgttatttagcaaagataggatttgaacccaatttattctactccaaagcctacattctttttagtgaccttcacttgagcaactgatgaactatatctgtcagggtgttcacagatgcatcatctgggaaaactgaggcagagaaaacaaagaaattaaattaattgtttattaagaaactaatagaatcatagcaccatgattggtaccacaggagaaaataaagaagctatacaacatatataaatatatacacttaaattcaacaggggttgtggacaaacatctttatgcacagcgctgagctaggcagttgggaaagaacaaatatgaatgcaacagtctctgacccaaatggaaaaaagaagcatgccaatatataatttgcctgagagtttgctttgagggtgtgccgatagaaattcagaagcagttctacaagggcccagaggagggagcccttcaggctgctcggggaggggtgcagtcagttgaagattctctgagcaggtgacagaactggcccttgaagattcttgcctttaaaggtcttcacccttcaaggattctaatcttggaggaaagatataagcaggacactacactaagaacaatgggagatcctatctcagtgagttccagattctgtgagacagacgatgcttgctttaggaattctaagacgagaattatccatctggcttgacataagaagtacatagggctctggctccagagaaaagctgagaaaaaaagctcaaagggccattaaaaattagatctgtggaaatgaaaagagggtacttatatattgagcacctactatgtcatgcaacacactaatctaatcctcatgacaactccatggtaaggtcacagagactcagagaaattaagcaacttgctgagagtcataggaacccaggtcagggtgactctgagatgtacttttaaccaccctcacccacattcaaatcagtctcaatctttagggctctactttgatgttacttttctaacttccagtagaatcttatgtcctttctggaaaaacgcttttagtaattaccaaacaaaatgaacactgaaggagtatatcataagagcgaagaaacagagtcaaagtaccttttaggaaaaaatcctcaggaacttaagggagtccctggggaggagggctggaaggaaggaaactaactgaatattggatgactagatgggaattgttgccttactccgataattagaggctacattatatttcaaatctggaagtgatcttaagaatatttgattccagttttttcattttacattagaacagaatgagatctaaagatcctacacaaagcagaataagatcctgagtcacctgacattgaaacgattgctcttctactaaaaatgattaaaagagagggaacacatccataaaagatcaagtattgtagtaaaaaagggatagcagtacatgatacattttatatatatatatatatatatatgtgtgtgtgtgtatatatatatatatatatatatgaaggtcttttatatatacatatatatatgaatgtcagtcatagatcaagggttagggtgggtcatgaaccaagaattaaatttcatctaattttatgcactcaattaaaaacaagcaaatacatacatacatatatgcataaagagttagaatggcttccaagacagatggaaacaaatagtaaatgtatgttcaatgaatggatgagtgaaatgtcttgccaaatgatcccagtgcatttgaggacggagatcaaggagttcaaggacccataagacatgaacttcgttgtcccttcgttttcctgcctcctacaggagagaaataacttggcctcctcaattcttgtttgtctttaagaacctgaggagcactttgtctttgacaacaacaatagaacaaatggtattcgtatatcatttttattgtttacaaaagattataccccagagcatatcttgtcctcaaaataaatttgccaagtagatattcccattttaaaggtaaggaagtggaagggaagagaaatgaagtgtcttactcaaggccagtgaactgatatgtgttggagggagtaggaaatgagaagtaaaaatcttgtgctcccactgctggtctgagaattgaataattcccagttgtctaggaatattcaaaattattgtatacaatgacttaaaatccccctggaagacatgcagtttctaaatgcctaattgccacaactgaagtaaatcagtagtcatggtccaacctctattggagaggaagggggattttgaatgatacaatttatgttgttcaacatagctctctttttatccaatggcaaccttttacagatgacttggagttgcaaaaagtcaaagatttgcttaggcaaattctttattcatgacattgtgcacccaagattttctttcctccagccagtctctggaaacacatttagggtattgtgctattttcattttatgactacagaaacagagttcaaacgttcttagtctaagactattcagcaacttctttctaaactaggaaggtatgaatctgagatctcccattttcagaaagcttccataatctttgcatatatcgcattccagctttcatagaggggatgtctgagtcatttgctcatccgacaaatcgtcatacttttgccaacaaacattcttccttggttttctctcttcctgaagcgtgtagcaatgttcctagctctcaagaaagatctggagcagctcggaagataagagcaattgaagaagaaagttacaatttagtggagttaattttatcgcagactttcagcacgctattcacatgcaaacttcacacagaatatttttatcactaccttattggaatagattggtaattaatagcttgtaatccaccattgctaacatgttttgacttattaaacacttggacaaaataaaagaagatctgttttgccataagggggagcttttgagttctataaagagggggaaaaaagaagaaaaaaatatattacatgtatgtcccagttcaaaaacagacctacaaagcagcaaatggtcagatccttacctgtgactttaacaatttcagaggacctgaattgcttaagttgaaaacattaggcaaattaatatttttctctcattttcttcttataaaattaaaataatttctaatgaccaacagagtattttaaagagtattcggggaaattcagagacccagttgtactaggactacagcttctgaaaggcagatgtcctggacagtgcctttcttctattttcttctgatgattccataagaactttggaaacatttgggttagctgaagccagccttatctgggggctcagaaaagaggggaatggttcatcatcgtacaactttaaggaaattctgagagggaaaaggacagggaaaagaagagggaaagaggtaaagggagaggaagcgggaagaagagtaagggagagagtgagaaaaagagaaagagagggagagggagggagggagagacagagagagagaattaaaaaaaaaaaatctaagaatcaagtttcaagactctttatgtgctacagaaaaggatgaggtttaccagcaaagtgcaaaggggatcctaagagaagagacagatttttctcctgccatcagaaataataataataagtggggggagtgagggagggaaaaaaagcaagcaaaacaaaacaaaaacaggaatgtgtgttttgagcaggaatgagagctgggaggaccgtaagggggtgtgtacagaatttcattaaattgttactttaagattgtctccttaaaaaaaaaaaaaaaaaaaaagagagagagagagagagagaaaaggagggggtggtggagaagcgggagcgaaggaaaggaggcaaaaggcaaagtgaaggaaagctggatagctcggcctctccaaactgattgattagtcatgatccccgcagttttaacagggactcattcaattgggaaggtggagcgctggggagcagattagcatacgcttgtttactcatcttctgagggattttttccccctctttcctttcattttgagaagaaggagggaggggaggggggacttggggggggagaagggggctgtggcttgtgttataaaggacgcaaaaaataaataaattagagcatcttttggggggagggaattcagcggatcagtcttaagaggagcttttttttggagcgagaaatcatataaaataaaatgaaataaaacaaggaggaaggcaaccagctgttaggggraaaataaggcagataaaggagcggggagagaaattaattgccaaccaggaggagttgggctgtatttttcaaaggtggggagagtggagcacacaccttgaggaggaaagcgagaaagaaaagaaaaaagcaagtggaaaggggggctcgcccaagaagggtgaagaagcgaagaaagtcgaggcgccgaggctcccaaagctggcagctccgggtggcggtgcagggcgaaggggggcggggggaaccgtcggacatgcggctctggakttkggtgctgcacctggggctgctgagcgccgcgctgggctgcgggctggccgagcgtccccgccgggcccggagagacccgcgggccggccgacccccgcgccccgccgccgggcccggccacctgcsccacccgggcgtgcccgacggcsgccgcgcytcgccgccgccgccgccgccgccgggcggtgcctgggaagccgtgcgcgtcccccggcggcggcgcagcagcgggaggcgaggggcgccaccgaggagccgagcccgccgagccggatatatttcagcgggcgaggcgagcasctgcgcctccgggccgacctcgagctgccccgggacgcgttcacgctgcaagtgtggctgcgagcggaggggggccagaggtctccggcagtgatcacaggtaggtgagggcgcctcggcgggcgctgcaccgtccctgcggccccagaggctcgcgggtgtctgggcgcgggtggcgggcgggtcgggggcttgcgggcgtgtctgtgcgagagstgccccgcgagcggsgcagagacatcgggcgagctgagagcctcactttgctccatcggtggaatgggcacactcggaaggcgtagctgctccatccctgggaggaacctggggagccctcctggcggccccgcggaccctcggccagtgagggctggttcccggagcctagggcacgtaacccgtgctccgaatggtcagatgcactctctccttttgggatgaaagggaggatgacccaattgagatgcatgtgaaaggagacttggggaccgttgatttctttgacgttttaatggaggtaactccccttcattaggccccattcccctgaaagccggcaagggcaaggttgttgtaatggccaggacttagaagtcctcgaagtgccccaaagttgctcactgattgaagcctgcctctgggactcaccctcaccccctccacgccatcccatgtcctakcttttaaagcccattgcctgtcactcggggctgggacgagaccttcctaacgcataccccgccagcgttccccagacgcggctgcgaaacggggcgcttttctcatatgggactttatgagcccgtaatgaatttgagttctccctcctcaacctccctctctctccccttcgctgttccacagcaaagcctatagtgaaatcggacactttgcgaggattgcaaaccttasaaatgctccagcatccattttcccccctctaaatgaatctgtggaaatgcctttaataaaactggggagcggaggtgggggcggcgctggaasagaggaggaaagttttgccttttctgtctgggagattccctttctgcacaaacaatcttgccatgtcctgggacgtcttaaagtgagagtaggggttcccccttcactgcagccaggaaacgtgtgaaggcgttttgcgatcccaccccctcacacacacactttcttagaagggaaagctgtgagctctccgggcagttctgcttcttcctgtctttccatggcttggactttcacagatgtagcactgactatccagttgacatgaagacccctttaggagacccacactctgctgctatcccaagaatacgtctcccgaagcccccgctttccagctatcaaaggagagcgatacagtgattccccccaacaacccacaactgacgtcatcgcatgctatttttcctttttttttttcctccgggaagaagaaggagactgaactcattcacttttaactcgcaagccctatttgcccagaggagggtctaatttggaacagaggaaacgttatccataataataatgacgatggtgataatttagagctgtagtatgttgacttctctttccaaacatgtgaaaaagcaaagagactgctgcttggaggtgatttttttttttttttaatctgtaggtctggtttttcctagtctttacctagtaccagtgatttggaaggcattccctggagagaggagagyacagggttatgcaggcatcatcagtgaaagggtagtgaatgcattttaactatgtacgtgtgtctacataaatacgtgtgtgtgtgtgtgtatatatatatatacatgtatatatatgtgtgtatatatatrtatrtgtatatatatatatatgtatatatatatatataacacctgggattccacaggagactgctttataaatgtctataattcagacaaggagcctctcttcacacacattctcttgagcactcattcactctctcacacaaagattgttgcagtaaaatactttaattggatggggggcgttaggttattattgcttgtataaaatgcctggtccattttatgtgtagaaataacattcctctcaaaacgaaaaaaataaaataaataaataagcactgctgtcgtgtagcaccagaaagccaggagcttttcccctgaggattctggtggatttcttttccctcccctagttgagttggagccagatttggcggcgtgtaaacacctggctctgagccagaaaagactcattctgcatatcctccacatggtacaggctgttggactaaaaagaacctgcttctccytgaattaaaaagcaaacaaacagaggttctttgcagaagtactttttcagctccctccttcgtgtaagtttgggctgggagagccaggaccgaggtgggcagcaaggatcgggtgcgaaggctcaccctctcgcggcgacctcaggtgcccagtktgctgcctgacctctgctggctttctctggctgggcgttgccactttcctaggaatccctggtcacctatcttgagagagcagtcatcgctcagcagggaccgcgctgctatttcaggcagagagttgctgtcttgctgtcaggccaggctgccttacatcactctttgctgcaggattcaattgggtttcgtaaaggtctaattttacggtgctgttaaccgggtctgtcgtctggcagaggcaggccttgccgctcctggtaggcgggctatgctcccagatccgcccgggatgctatttctgccccggttcaaacttcactgacaccagttcagacaggcgctcggagagacagggggaaggagcgaaggagcagtttgcttctgaagctcagaaaacatgccttttatttttctgaaaggaaaggagaaaaatatatatactaatacataaaaaaagggaaggcttatgcaggcaaaaacaaagccaaagttagaaagtgcctatgtgtaggattctctggagggtccaccagtggatggtctttaggattgaagaatcctttaaggctgctgtgaaaagggtcctcagaggttacccaagccagtttcccttttggccgaatggggagagagacacacagagaggggaggggtgtgtgctggatgacacagctmctcagcggcaggaactaggatttaatccctggcatctgacttccaggccttgccccctgcaccgctgagagaatgtgtctcataaacaccatcacctctcaccccacacggacccaccacccacacacagccttcagccttcatgcatagcaatttgggctccctttcaagtcaggggatgaggggttgtttctgacacatccctttgcttttgtaccacaccaggcaggaggaaccagacccctgttcctcatccccaactgcccccccaacacccctccagtttgaaagaaaaggaaaacaaaagactcaatttgctccatcgagcagaggccttgagcagcagttaatcttgttaaagtttctcctgacctgttagataagtgaaatgtggaccccacaagtactgccctcctcccacccctgtcccactccccttgccttagtgattcggaattcctgctcagaaggagaaaaggatttacctgaatcccatccagcacctctgcttgccagccttttttcttttgttctaatggttggactggattaagtgtgctggttactcccaagaatctttttttccttcccttctgcacccccacttcctagtatccacccaaccctcaaaaaagagtacccacattttctccacttcagcattgctgtaacagtgaaggctgggtttaagtatatggctaggagtccatatattaacaaggcttttccccagtatctgtagtcctacctgggatctagaatattgtaatagttagaactcagttttagtagccaggttacctatgtggaatctctgcccctaactaactgtgtgaccttgggcaagcaagctagttgacttctctggacttcattcaccttcctcatgtacagagtgatgatggcacaagtacctgtatcatagagctgtgtaaatgctaacagaacttggacatggaaggtacttaaaactggacttggtatgtagtaggtgctcaacaaacttcattcttattagacatgattttccaaatatctcagtcttggctttctggactggggaacacttgaaggtatgaagaaatccaactctacctgggtgcttccttggtgatgctgggcactttccttgtgccagcatgttttgccttcacaactaccctgagaagtgtgtatcgtcgcctgtacttcacaaaagagaaatctgagtttcagagagttgaaatgacttggtctaaagtcccacaggttctcagtggagagagcctagatgtgaacccaagtcctcgtttcctctgtcagcagtctttttggagagagaagaaattattcacatgctcttccttaacctttctgtggaacatttccattcctttctgcatctctatgtgtcaaccatatacctacagatcgaagasggtgagaaatggatataaatctcaactgaagccctgcatgagacctggcagatctgtttttcttttcacatcaaattatcagacagacaggcttggaatttctcttacatgctgtgtaatttgagtcaagtcacttcatccatctcttccttggtttacttatctgtaaagtgggcataatgacatcaggatagttcaatgaaataaacatgcaaaaagtacccagtgcagtgtcaacttgtattagagactcagtcaagggtagccggatctaggaagtagctgcatctctttttccagtttgcggctttggctttcaaaaagtggggccwgtttgtaaggcttcccctcttgagttgckggggagtctctctagagtagataatgtatcttggggaacaattagactccttcaaatacctttctttcaatttgatcttctcctctttgacatgctaggattacccctctgtaataagagccaaaggaggcccagaaccactgggacctttaaacaggaaaacaagttagcattcagagagagcaagcacctccagaaaaggaagccacacagatctactgtcggcctcttgctccttccccaggtgctcctcaaactctcaccttccgttgagctgccactcagtgaacaagtagaagtgataaaggctgtgaaacctgggaaagcacctcccatttttccctgcacagaggaaggcaaaatcaaggtccagaratatggaactcgggagtgtgggttgtgtatggccagcctggacatgaactcagtgatcatctgggtcaaacagctcactgtgcaacaggaaagttgaggaccagggtcacacaaaattaaactgtattcacagatgatcccctctaaatggtctgagagatcatttggtccagcacttcccattcctggctgcacctggaataaccagcttttaaaacatccttctgcccaggctgcaccccaaggattctgatgttgtgggtctggggttggcctgggaacgggtgtttcccaaagccttctcaggtaatgttgaaggaccactagtgaaaataattactgatgtagtctgacatcctcttgttctgcagaggcccaaagggtaaacgatgttccctgcttactgagctgggtagtagctaagcatttggggaagttccggtgccccagctctgaaggacccctcttccatgctgacttcctctgttcactccaaacccctgggtgccacaggtcctgacatttcattttttccagtgccattcctgtgtggaaccatggtggtccccatctttacaggaggcacctgatgtcaaatgaatctctcggagttttggagagagaagcctctttgaacaggaaggattataagaaagggaagctcagctctaaggcattcaccattcactttgccctgggctagtcctttagaaagatgtgtgttcctattacttcaaaacccctcaccttgagatccctctgaaaccagcactggctgcaggtgtctccaatgaggagaagagaaaatctccaggtactagaggactccctctatgggcaacttgtatcttatctacctgtggctgagggctcgggaatccagtaggtatctatttctctccgcaccagctgccccttctctagaacttagttccctttccctaaggttctcctaactttcttcttactgcagtaagagctctgcttcttgccttggtgcagttactggaaatgctcaactgtgattctgacatcagcagctgagaaccgacttgtaagttccttggcttgtttgaagatctgtaagtgggaattaggaggtcagcgttcaggtcctggtttggcttcctctaagctgtgtgacctgtggtctctgacttaaccactggggcctcaggggagagggtttgggggatggttactctcaatgtccccatctcatgggctgtcatgggaccaggtgagacaatgccgggagaagccgttggctgaggtcagaccacagtgcacgggtcagcatggttaggaggagctagaaagtgagagatgtgagggattagtgcaatcaaggtcattcctggaaaggtgcttttattatsatcattcacactgtagatgataaacagtgatggagttagcaaaccttttcatgcctgtgacctcactggagttctttgatgttgggacttcataagtctgccaaatcctgccacttactgctttatgaccttgaccatttaccgcttctctctggacctcagtgttctcaggatgcaaaaggagggtcaggggtaaaatagcgactttcraactgtcaggggtaaaatagcgactttcaaacttttcaaacttctgggacaagggtgaagggcaggactctgcctctctccttcccttcaccttattccacttaaattgtgtgattctacaagcttatgtttaaaggaatatgttcctccattacaaagagtttaaatggatatggacygacattgaggagttattgttaatcttgataggtgtgatatgatattgttgttatgtttttttaaagatcctaattwgttagaaatgcatactgaagtacttgtgggtaaaattatgttttgtctatttwgtttgtttatttgtttaaaaagctccagaaaaaaaaaaaaaaaggttctgggggtagtggttggtgagagattagcaaactgataacaattgttgaaaccaagtgattaaaccttggagctttaatacatttttgttcatgctgtggtgtgtgattgaagatttccataataaaaagttaaaaatactaaaagtgtttgagagccacaggaggaagtgaagtctcagttccctgcgtgttctgtgacctgaaaggtttgcaaatacggagaccaccgtttagagagggttagggactcccccaaggtcgcacaaagattagctgaaagtcgtgacacagcccaggcttcagatctgaggagctccccatcccctcctctctgtacacttgcaaactcaagtgaaaatgattatccagggagaactcgaggggaataaaagtgatgaggggagccttaggaggagcatggagaaggggcaagtggaggcytgctctgcaataagaagcttttgagtgagaaaattatttgctgtatgggactgccctacatattgtgaaatgtttagcatctttggccctgtttatgagaatttcatgggatctgttagtgattgtgacmggcccagaagtattgtgacgatacacacacacatactcatatactcacaggtccacatacccttagttctcgtttttctggttccttatttctctccatccctaactacctggagagcaattctagagccttctagaggcctggggcagtgacctgcaggagcatatgtttactgaggaagtattttgcaatggttgatcacaggactcaggaatcaaactgcctggtcaaaccctgactattgcacctgctggttgtgtgaccttgggcaagttacttagtatctccaagcttcacttttcccctctgtaaagtgcagataatactagctgttacttcatagggttgttttgaagattaactgggcctccatgtggaaaatgcttagtaatggaatctagaccatgcggtaacccagcaaacgttaactcatatcagtattatgtgtgccagccattgccacgcattatttctaataatctcaataactctaggagttagacatacttatctcttttggcaaagccaggaattgccttttcctcccttacaactcaggaaagagttattgctgtcatcttaacatagaaaaattaaaaatttaaacaactaaaatgaaaggctaacaagataaacacattattgtgtcatttaaaaaaaaatagtgcatgctcattgtaaaaaaaatctcagaaatgcagacaaagaacaagagaccaggthaaatttgtctatttcctgcccaagcatgcaacaactattttttgagtttctgctctgtgctgggtacagttttaggccttgaggacagaccagtcaacaaaagagagaaacatctccgccctcagggagtttatattctgggcagtgggtgttggggagaaggtggagacagactataaatgaataagcatatatatcccataatgtcaggtgaatgtttgtaaagaaaaagttgagaaggaagtctaggaatgctgtgtgggaktggggatgcaggaggagagaggagtgggatatgaaaagagtggtcaagggaggccatcatcakagtagctttgaagaaragacctatgagcaggcctgaggctctctggakaaggccatggtgtatcgcaaaaggaggagcaatgctttgagctasgasatgtcagtwctagcactagtttgctgtgtgactttaggcaagtcwctctccctctcagaaccagttttcacatctgaactttgtggtactgtagggattatttgcactaaagacacttctacaracacttcctaggattctataatcctcatcaaggctgtcctcagacaaaactgtgaagttggcaatagttccagttttcttccttttctggtgtattttcctccactaggtggtgcctgtgcctgtcaccctcaggggccaagtgtggacacattttcggcttccacacctcagcaacactggggaaaaaagaagatggtacaccttcttgctaagtaccattgactggtaacaacttggaatgttactgctccattggtgratactcttttaggacttcccagaaagctttgtgtcacaaagcaatgtaacagtggtagaatttctaagactgactgaagacattatttggggaatattggtacttcctgatagctggaatccatcctattaataatataactaattctagcccccacaaatatccagaaaacttgctgagtgactcccagtcatcacttactgggtgaatgctagcatgttcatattttgtaatttcttaggatataaaggccattccagacaaattcctggactttggaatagaccaccggccttgtagtattgcttatcattttaatcagataactcagtgaattaaaataccaaaactctggagtctgtcatcattttccagactattttccttcagaggatccctggaactgtcatctctgaagtatatccagcttcctctcaactccctccttcttctctctcttcctactcctcatacccagcttatttgctttgaccacttggatttttctccaaacaagataaagaaaatgtgtttgttttttggtattatttgccacaaacccagggtccacagaacttggaagaatataagaggttcccctcttctactttagattgtagagaaccctggtcaggtctcagattccaacccacttggaggaagctaagacataaaagctggtcagtaacaacttggaatatcgaagtatgtgagtaggggcagcgtaccactagttgctgagacctgttatagccttgtgtgtttaggaagccagtggtccaacctgtacctattatccttgtaatcaagaagtcattcctatgcctgtcccgtatccattcctgttgctcmatgaatctgaaaggtggctcggcagaatgtggccaaatgcatttatatggagggggttattttccccagtgtgactgcagatctttcagctcagaggctgatgaatgaagagagaaggctgtgttaataggctaatcttaagatgcaaggcacccaggcagaaaacataaaacattgataaatgtgatactcagttttgtgaagtaaacttcatttaagtccaaagaaacaaggtgtgtcaaagtccaaggactcatccaagccatttatttcatagatgagggactgagggttgatgaggaaagtggcttatccaagtcagtgaccaagctgggtaaagacgagtaccattgactgataacatcttaaaatgttactcttccactggtaaatactcttgcatgactgcccaaaagctttgtgtcacaaagcaaacaacttagaatgttacttctacattggtagatcctccattggtagatactttaaagtcttaagccaggtctgggtccacttgtctcctgactttacaccctttcccatagattaattacccatctgtctactaatggtagttatttgtccagactccactgggctccagactcacagatccacctgtctactggaaatgttagcacattctacaaactccacacttccgaaacaatcatctttcctccaaaattccttgcatcctcatcttggttggtgtcacccactctacattacatcatctaccatattcaatcagtcatcaactcctgactctcctgcttccttataatgtttatagacaaactctcttctctgtaccttaaatcctctttatttcttgctgtgactatttccttagtattataatgcccacttctctgaaattcaatccctgcacccccttcaacctgcccaccaacatccaacagtcacatctgtccagaatgcaaatctgactctgtcacctctagctgaaagctcttcaataaaatctgaattatttgaaattcccccaaatgcacctggttctttaattatcactttwtttacttggcttatcttctatttccagtgcaccattttgcagaatgtttatgccttcccaggattttgccagagttttctctcttctgagaagcccttcataacttccccaaagtgtaacttgttccctaccttgttcatctgttcccactatgctttctgcacacttttatcaaaatacctggaattatgacatttaattgtgtacatatttgagatcttatccatctcaagttctctattgcctagctcagtatctgacctataaaggggctatatgtatttttgtttaataaatggataactggataagagaaccagtttaatatctaatgattctgggagaaagagctcaggaaccttaggcatgttgcattacgtaaccaaagcacatgacctagcatgtgcatcactgtcagaaacattacacagtggttaattccatttacccctgagcaaagaagtcagaagggaaaagaaatctggccttccaaaacagaaggggaaggggaatagtatatttaagggccttctcagctcacattgggctttctaatccaagccatattttggccttggtcttcgcctctcagccctgtgcctgtttgcaaagcatttgttttgtgtgtgcacggcagcacataatcttaagctttgcttgcctctcaaatttccctctctcccccttatcagtgtccttctgagcctcaagtgtcctggcagtcatatctgttgcttcagtcttcacccatttccctcctttctgttaatggggctttctatctgctttccttgattttccttgatcttgtgagaccttgtgatgacctcaggatctggaattctctatccgctgtttatatacccctaggagagaagacacattctcagcagtaataacagtaatgaaagcagctagcttataataagcacttactatgtgctggcactatgctgaatgctacactttgaacactctgaaactgggttataaagttgcatgactccctgaagtaccaattgctaatgggtgatgaaactggaattctcatccacaccagtttaattttatctctcttcatcctcaaggcctgacacattgcttggaacaccgcaattactctgtaaatgtaccatgagagaatgaatatatgaatgactgaatgaatgaatggtggtgccccccagtggctaatgcaaacatttgaagaatgtagaatggaaaggtaaagaargaagagagggagggatagaggaagaaatagaggaaaaatctgaatgaacattataagatttcaaaaagattggctaagaaatctcagatatgcaaagtatattttatttgcaggtgattttcaaacataaagacattttacatccattagagcatttcccacctttaactagtcctttargagatatacagttgtccctcagtgtccacaggggattggttcgaggaccaactccctcaatgccaaaatctgaggttgctcaagtccccaacataaaatggcatagtgtttgtgaataacccacacacatcctctcatatactttgaatcatttcttggttatttataatacataatccaatgttaatgctatacaaatagttgtaatgtggtattgttttatttgtattatttttattaagtattatattttaatttattctgaaatattttcaatctgaatttggttgaatccacagatgcagaggctacagataaggaggaccaattgtgcacttatttcaaagatactctgtttgccaaaaatgtttttggattcttgttttgagaatcagtgcctgggacatgtttccccagatatgctcaatggagcctccttgtcatcctctgatgaggggccctgatgcattctcaggcaaatcttggaattatgtgggtgaccatgctgagtgaatatggggttttgaatagaacagtgactctggagtaacaaggctgatttttgggtgactatcatcagagctgattaagccttgatagagccaatattaagctctcaggatgacccctttacagaaaagcccctcaaaaggctgatttaatctgctaaaaacaaatgcaatatcttgaccttccctttcccaaattctaaagctggagtaacagaaactgccttatcaaatctgctcagtttactgactgagaaactgagatccatggatgtttacctgctaaattaagctaagctaagtgagtaaggttaagcagcaaattggcagtaaaattgaaactaaaatttagatctgttgacttccacatcagtgctctttccaytgggtcactttattttcctttacagtgtggggtgatagttataactatgggtttatattagtaagattaytagaaagcatcatacagctgtttaataacttttttaaagaacttcttatgtgccaatctgctgtcctagacattctttaagattcaatgagaaatgaaagtttattaggaaaggtaaatgttccttcatttcttccttctttctaaccattcacccttctatttcatatgtagttattcascaatttttatatattatacattgagttaggagataagaattaaaaagaagaacaaggcatagttccatgccttgaggaactcccagtcctagtggtggaagcagactggtaaacagatagatgacatcatggtaactgctataactaagcaattaacagagtcctggggaagcacagagcagaaacactatgttatgaaacacccatgtttatcatgagagtgaaaaagtgctctgaaatttcaaaggcataagtgatcttttccacctggaaggaytggggacttgttcatgaagtgaatgtgtatgtatgtagagtgtgygctctgccttgtgtgggggtatagtcatgtatgtaattttaaacatatagccataaatcaaatgagaacaatcaacacttctggwttcatgcctcagctgtagatacttacccagagtatcttttaggagtatggtgttaggaaattattggacaattcaatatccatcaccatctgcatcaagccaatgcaactccttatcttccctcctcatagcatttatcacactctattgtgatttccttggtatctgtctgtttctccccaattgtctctgagctccttggagcagagascattttggtcttcatctttgcattattccttttacttcgcacaatactagtcatgtcggtgagggctggctaaacaatgttaaatgaacgaacagattagagatggctccaaataaggaataacataaggtgattgaatgtgagtgctgtgaagaaaaggtgctttgagaattaatagcataggccttagaaagaccaaagagtgaaggcagacacattgtgagtggcattgactgtgagatatggccctggtctctctgagctaaccagttacctattgaaatgtatatgcttatcatctttccctatctctcttcctctctttctttccagtgaaccagtataccatctatgccagctttaagtcccttccatgtggctgtccttcggcctctccaaacccattytttttttttttttttttttttttttttgagatggagtctcactctgtcactcaggctggagtgcagtggcacaatcttggcttactgcaacctccacctcccgaggtcaagcaattctcctgcctcagcctcccgagtagctggcattacaggcacctgccaccacgcccagctaatttttgtatttttattagagacagggcttcatcatgttggccaggctggtctcaaactcctgacctcaggtgatccgcccaccttggcctcccaaagtgctgggattacaagcatgagccaccgcacctaacctctccaaactattyttagaaagagctgctaagagctaggtggaattgtaagggatgtgtccatgctcctcctgcaatcttcacctagaatataagaggatgaggatggcacactagattttttttttttatctagtgtgccaggaagttatcagagagcttcaaacaatggagttactggatctggtttatggtttccaaagatcactctgactactatgtgtagaatggattgcatgaggccaagagtggggtctcagttacaacagcatcatgatcgattgctgatgttatgacttagtattttggttaatataattatcatttatttccttatgaatacgagtaccaagtgaaataccagaatagcactcctattttagatcaacgaggatagggsagtttttgcacttgggttcagaagtacttgatttgtaaaccccaagacattttctgtaaaaatttgaggttgtgcatatttttctggagtcaaagttcttcttagttgcttaaagggatatatgtcccccaaatggtgacttacatgctgaaaaactgggggcataccaggtcatttcctgaagcttgttcccagctctaaaatatgaacactataggggatctgtgataatgagaatgttgatgttgagttgtcatatcagactgagcaattgcactttccttcatctgtacccttgttggagtaaatagaatttggacctttttttcctctgaggaagaattagtttatttcttagaaatataatctacaactttgtttattcaaactctgctttctgagtttctctgagtttttaaataggcaagtacacttcaaatgtggtctgaagtggtcctgcccataagtattcactgtggactttgaccatgaagccacaaatccagccacctatccacccttccatcaatctactcttccatccattacccatctattaactctccttccctccctttcttccttcctccctacccccttatctccccccactccctccctytyttccttstttccttccatccacccttccatcaatccatcccctttcatccccattcattccctaatccatccacccttcttttctgctatccatccatctatccatccatccattcatctgtccatccatccttccattcttggataaatgtaatcttccatttaccaggctttgtgctaggactggaggaagagttaggaggttccaattcttgtttttatgccgctgtgagttcttaaaaaaaaaaaaatcccctgagacatcttcactgaaccttatgcttccacatagtagagtgtgaaaaccactcattgaaaactaatttgaaaagttaaagtgttctgcctgcatagttctatcatataaatattcctggtagtgctctgagtctggatctagactaccagaggctcctttatcaacagtaatattttagatcaataacagtttctacccttaggttagcaggtactggaaaaacaataggaagtttgaaatggaagcctttctttgggaaagggcaggcttaggtgagaccagagaagggagctgctagtcacttagcctctgggactcttttttcccacagcctcccaaagcccttgtttagtgatgctgagccttcacattctgtgtatgcctctggatgtatgatgtagcagaatgcccttgtggcatggggttgtttcagtttccaaagcattttcgacatctacctatcatattcccactcgccttgtaaaacaagcattttcatttaatacagtgaggtctttgtattctcaacaacaaacacatggtccaaggctctaggacacaacctgcctttttctccaacccccactttcaacccccccaccactctgtccacccttacraagcccagtgttagcagaaatatctgtttacaaacaagtgttccaaaagaacagtatcagtagctcaaacaagcctctgaaacatgcctctgattctatacttggaatccctgtgaacagtgggtatcactggcagcagctttcatggaaggcttcctgcctttccatccttccgtctgtcctcatgtctgactttctctgtctccttccccttattcattgaaaccatggggaggctgaactggagaggcagtcagatgctggcctgggcattatggatatctaggagacaaagcccagacagggagttgcttgcagacagcaagacaaacccaaacacatccgcctgcagtgttatctgaagcagaagctgattgaagaaggattattaattgggtggatataatagtcacatgataatcatgcagctctaagcctttttctaaggtttcatcgactgaggagctgytattgctgctctctggaagttgagtctactctagctccctattacctatgcataacagctaatatatttaatgcataatatgtgtcgggcactgttcataaaattttgcatatgttaactctttaatcctcaccatgaccctctgaggtgggtactattattactgcaattttccagatgaaagatgaggaatgttaagtgaatttcccaaggtccacacaagtcagtggtagaagcaatcttcagagtgcatattctaacccctccaccataaacctctctagattctctagactggttctaaattctgtagcctcacattcaccttcctccctaagcattgtttactactgtaactttccctcgttgcttccaccagggatgctaaacctcaccactattaacattttggaatgcataattccttgttgtggagtttgacagcatccctggcctctatgtactagacacagtagccacaacctcctccccagtgtgatgatcaaaaacgtctgtagacattgccaaatgttccctgtgagcaaaatctactgactgagaaccactgacttacatggattcttctgattaaactgaattacctgatactcctaaaacacatatttctccctctatgctttttcacatttgttttcccctcttgagcttacagtgttcttggcctcctcctcatcaatcttctctgtttcatagtctttcagttcctcagcatcttttacagccagaggaaatactaacctgtctggttactgatctdcttgtttctatgccttttttgtttaaaaaatggtcaccacttccaaacttttgatttaaagtcccttaaagatccctggagtcttgagtttaaaatttagtttgtactatgcattccacgatgttttacagagtctaccatgtatcagatctcaagctaatcactgaggatatgaagtcaaaggagataaaatccctttctttcaaggagtttatgagatagactctcagggaaataaagggatctgaagatcaactctccatcctccttcagttgaatagatggggaaaccaagagacaaaaggtagatgacattttctcaaggtcagctagagaccaggatcaaggctgaactaatcatcctctacctagtgcaacaaaatttaaattatgaagccccaaagagcatctaaaccctatttatccatttagagccttaaagcrttttttgagttgagttatttataatttatgattttctaacagatgtcaaaacaatagaaatttagtagtgtatcaaacctctctctttgaaattgtgctcacatttcaccctcttcattaatgagtcttaaggctaaatgactccagattgccacatgagcactagacaggagtcctgagactttagtcctggctctgttagctctgtgactgtcaaaaggaagaccatataatccccagctaatgatccccacccacccccatggactgcctcaaaaaacaccaaagattcattcttttctatggaagaaactttagatcttttrgcatgtcattcacaaccctttgtgatctagcctcagacagccattgtacttcatttccctcagttactctgtgcaccctcaatcccatcaaaagcaaatatctttctcatctcgagagtgacctttaggtggacttcatagctcttgccattgctgatgattcaccttgtgctagaaagtctttgaccagcttctccttccccaaatcctgtacctcatgcaaggctcggctcttttgagactcatccaggaaaacttccctgcaccttcttgtcagaatcaagtagtctttctgctgagctctatttgcttgtacctctactatagaactcgctttattactctttatttatcattaaaagcagccccttgtcctggtgtagtcagctttcccctgactaagcagaaatatttagaagttaaaatgtgaattctggagtctgattgcttggggttgaaccccatctttgtcacttggccaacaggttactcaggcttaggtgagttatttggactctctgagtctcagttttctcatctgtaaaatggtgataataataatatttccctgcttgcattattgtgagagttacctgagttatctatgcaaagagtttcgcacaatacctggcacacagtaatcactcggtaagcatcagctgtcattgccctccctgcctagaarggtaattctggagggcaccagccctgcaaagtggagatctgcctgtctggccttgtccctttcttatctccctttgccatctctctcctgaaaggctcaccctaggctgtgtgggccaagatgaggtgatggcaggctcatctgagagaggagctttttcttcagagctcagcccacactgtgtgggctgtgtttttatacaacttgctgtaggcctgcatcaggtatgaaatttacatcatttgacttgcccatgtgggaatcttccccattcctcttggctccttagaatgggtacaggtgttcagtgcctcctcctcccaatgctcttcagcagatgaggaaccgaggtccaaagatgaaaacaaggctgatgactcacctgttagacacagttggcacagtgcctgaggtctacagtacttttgttaaactacaaaaatggattaattctttcttttagaattaattaatttcttttagattaatttcttttagaatcagaagaaaaaataatataataataatacatctaaaataaggaatccagactctcaattacatttatttttataacaatgcaatcataaagcataattttggaagaaggagcctatgaaagtcatgaagtgaccatggatgaaaagaaatttgcccaagattaatagtggcaaattaaagcacaagttcccgtcttattaccctccaaatagaaatttttttctctgcattttcaagaaaactggtagaatttattttaccacagtcatcttctttcacaaataagaaaacggacacctgagagagagtgtgacttgcctaaggtctcgccaacacacaactaagttgtattttcctaactccctgttactcctttcactatttatacattcaaacctaatgaccactgatgtcaacctcccattatatagatggaaacatcgagggccagaaagttgaaggggcttatatgatgtaacaaggaccgccactcttgcctctaaatcagggcgccctccagtaccaagaggagcgtttgaaaactggatacacaattttgttagacagcaggaatcacttcaagagatctattatacaacatgatgactatagttactattgcacacttgaaaattgctaggaaaatagattttaagtgttctcaccacaaaaattctaataagcatgtaarataatgcatacttaattaacttggttcagccattccataatgtatacgtatttcataatatcatgttgtacagtattaatatacataatttttgtcaattaaatacaaatacaaataatacaaacttaaaagaagaagaaaagcttgtttgaaaccaaaactccccccaaattaggtttcctcacaagccttgggcacataaatctttcatttatttatccattcagcaaatgtttattgaggacttatgtcctagccactatatggagggttctatatagtgatacagggtggtgatacaggctctatatagtgatacagggtggtgatagacatgtactgtctgttcttatgaggcttacagtcgagtgggggagagtaccattggaggttgacctcagaaatgagtcatactgtcaacagtgatcattgccatgaaaaaaaattagatcaacaactaaacaaccaaaaacagtattaggacctcagaaagactcaggagaaaagagaggctgtgccctcaacaactacatgtgggaactatcaagaaacagcccaagtgtcctgtggctggtacagaaagatggctgggtcaaagactgactacatctgtgccagatagcaggtgctcatcaacacttatacactgatggtggagactcatgaagactgaaggtctactggaagaagtaatactggtattgtcttgaagatcagaaaagagaaaaggacagggacaatagggagacatttctacctgtaggaaacagtgtgggccaaagtgaggaaatcttaccagagtctgtctacacactcagagatagattgagaccaatttctgaaatgcaaaattgttgttggtctttattctgagagcatcagagaaagaggtttgtctgtttgggggaatagtgaaaaataggattttaggaagatgaatctggtgatgcttcacaggctgtataagggagcaatgaaacttctggaccatgggccagttagaagagtgttccaataatgtaattatgatggattaagcaccagctttgttttttcataccctttatggtgcataataggatgctcattttaccaagtaacagaagaaaagctcagaccaaaattatgacttgctctaatctctgctccatggtagcagagttgatatttgaaatcatatctcacaccccagcttggaaagataaatatccctctctcctgttagtctgtgaacttgtggatagaatactatagtatccacataactgcatgtagagcattcattcaattagagtctgttgagcacctactaagtgccaccattatgctaggcaatatgtgatatattcttttaaactttaaacatatgtgcatgaacatacacacaagcaaagttacacagagaaataaaaatggagttgacaagatgagccaaggtctgattatagcaaaactgggagaaagttaccacatcagggaagcttcctttacttctccaacagtattaatggctattaatgtcttgatctctggagtactgagaggaaagacccccccccccaatatttttattagtgacattaaattgacatgtccatgtggctttgcagggacatgtaaaatatgtttctgagcttatwagaaacagttctctccttcttcttcaattctgtctcatttctctgatacttcccatgtgcatttggttttactttcctcacatacatccttcatgatgcccatttcttggatgcttattgtacaccatgcactttgaaaagtgttctatgaacagtgtcttattacatccttccaaccagagctgcctcaaggtcatcacagagccagaacttaaaacagctgtattcactcccaaattgtgctcttcactaccagactgtccactgtgctttcactcatgcaagcaccctcacatgcatttctttatttccccttaaatgcatgcatacatataagcattttgtcaacttaattggtgctttctacttgccaatcattgtgctggcctggaaatatgagtggtcagtcatttgttaaaatgttgtacagatgattcaaatatgaggttaggtgtgaaaggggatgattaaataaccagtaagagaatttccagccctgactctgcctaattcaatgaatggtgaagggtcagtcttggggctgccatgcagggtatgacagcaggatgcactggtccttgaccattttctggcaagtggtatcattgtctccaggcttgatgagtgagtggagagaggagcttgtagattctcaagtcattaaaatgaccgaaggaaagatctctcttccaagacagccccaacatcagccctccttagtccaccaggatctggtttgtgctgtgcaactttcaaggatgaacaatagttcatattgttatagtgtacttctttgaccccatcccccacctcttctttctccttgatctttttttcttgtccttccccacttcctttcttacgttgatgtgcaccaattttatatgcactgatttcatcgacaatgtgtgaaaaaagagcaataaacatgcatcttcatttcagagaacagtgtcagaaaggaacctttatgtgtgtgtttaacagcacaaaaaggggggaaataatcccaattctgaaaaagaaggaaagatattattttttgtttgtttgttcatttatttgtttgagacggagtttcgctcttgttgcccaggctggaatgcagtggcgcgatctcggcttactgcaatctctgcctcctgggttcaagtgattctcctgccttagcctcctgagtagctgggattacaggcacacatcaccatgcccagctaattttttgtatttttagtagagacagggtttcatcatgttggccaggctggtcttgaactcctgacctcaggtgatctgcccacctcagcctcccaaagtgcagggattacaggcgtgagccaccttgcctggccggaaagatatttattattaacacacatttttaaaaagtgtagctacaacaatcccattctatgcaaatgagcctttggattctcttactaaatcctcgaaatggcactatttattaagtacttattattatcagtttacatatgaggaaactatcaaggagataaagagattttgtccaaggctacacagctaacagggagcagagctgagatacacagatcagcctcacaccactgtccatgtgttgtaacacttgttttgttgccagtggccatgtgccaagtgctgtcacatttgttttatcattagttcccccactacaactgtcagaggaagatgtatcatccccattttacagatggggagactaatactgggaaaggagccctgactttcccatccatagctagtaaatggcaaagccagcattcgaactcagatttactggcctgtaatcccccaacctttctacgtccatgcagactgcttacacatgagcaaaggaggaaggctggagacacaagagccagagggaattacagtttgccatcccaaatgtaccacataagtctgtgtattattaaaacttatgggtttcaggaaccctcaggcatactactctcaagcttgcctcacatctggatagccttaaatagttkacaaggaaatatgcatacatttatctcttttctctctcagaagacatctgtgaagtatacargataagattcttcatcctagtgtacatgtgggaaaactaagkttcagagaggtgaattaacttgtctgatgtcacacagctagtaaaaawggtgaacagacccatttagtgagggtgctttcagataacagttcctggcaaggaagaagaatacaggcaggagaacagacacaggtgccatcaagggtgttcattctactgctccatgccgtcctgcaaaaggaaatctggtcctcctcctacacttgcatggccaacacatgggaaacacctgagctaaccctgacttggagaattgttccatgtggttactttcaatgctcctgcctctcttgaacaagacacagagatgtccagaacccagtataacttggtataatcctccagtcctgtatgtctccctttaagcctcctccttccactgagcctraggcaaatcttttgacccggggtggacccggagggatgaggatgctgaggagcagtcccccaggtaccctcctcggtgatatcccagccttcctctgaatgcctgatggtgctgagtcctccaggtcattttggtgggtctcccccccgactgaaccaagtgcagggaccatgggtatacttaacccaaatctgtctgttttaatcactgtcctctggacagataaaagctttccataggattgctctctcaagcattcctctgtggctttgatactagtgattaaatcatggaagggaaagcaaaacaaaacaaaacaaaaaagggaccagctccaacctttagcttttaatttttttagcctcatgaaagaaaccagattgttgacctaaattccccctttcatcccctcatcctctcacctctgcttgtattctcctggcagatgtcccacagctagtgggcatcctttaattgaagggtctgaaactgccttttaccctgccccacaatgaccttacatctcccgcagggggaaccaaggctgggatacctgtaatcgctgggatcttggagtcacagaatrtggatggaagggacmtctgtgaccatgtggtctaacactcttatatcctaaggaaaggaagtgaggaagcccagagtagggagctattcacccagggaccacagcacagcatggcagacctagacattagagccttcatggtggattgagagcaccaatccaccatggaaagcatcttggtggggagctttggctctggagtgaaagagatgagagttagawttgtgattctcccaatccctcgctgggatccttggagggaaaatcaattaacctctctacatctcagtttccttatctgtcaaaagaatactaataaatcccacttagtctgtgcttagtaaagagactactaaatagaggctttcagaaagtgtttgttattattatcattatttatttaaaaataccactttttcacagcagaaatgtcctggtggagttttttctccttctrtatctactctcccaatgagagaaaacaaacaataatacgaattgcatataaattgtcatcctttgctaattatctccaccccgccgcccccagacagtgatggcagaaagtcaaatgttatcagagataattttatgttgacttaaagcttcccaggaaaacatcctaggcaagaccacaggaagaaagcatagctagagtccccctcagctgtgggggagctttcaaatttgaaatcaggagactcgaattccagtttttcctaccccttagtgctgtgggactttaggcaggggacctcgcctctctgactttccagttttctgatctgtaaatagtacctattgtagcagattgctgtgaggattctaggagacaccttgaggtgaggaatgtttcctgtaagtgatgaacacaccaccaattttgctatctttctaatacaccttgctctactcaaaacagcaattgagtaaattgagacattgcattgtaacaagagaaaaattctgaactgggaacaggcattaggagataagatagattttagaaaaatttcagtgggagagcttagaaaacttgttgaatgatggtttgctagggcaggcataacaaaggaccccagcctggctggcttaaatgacagaaatttattttcttaaaattctggagatcaaaagtccaagatcaaggtgtcagccaggtttgtttcttccaagacctctctctctctctctttctctctctctctttctctctctctctcactggtttccagatggtcatcttttccttgtatcttcacatagtcttttctctgtattacttgkgtcctaattttctcctcttataagaacaccagtcaaattggattaggatctgccatgtcacctcactttaatttaattaccttttcaaagactgtatctccaaatacagttaaattccaaggtactggggttacatctttaatgtatgaaatttggtggaacacaatttcatccaccacaatgaaaaggaaaatgggaggcagccaaaagcatggcagcaagcttgggaagaaaaatcagtatcgacattggaagttagaggaaacctgagtcagaaaccatcaggcaggtaggctggtaacggaaatccagatgtcgaaggacaagctcaagtaagcactccagatggacaactatgcctggacaaactttgggttctagcgaagtgggctgagcccagtggaatagattactctttggtaataaagaaccatcaattcttagttaattgtttaggtccctacagaagaatgataaagacagcagcctcctggctttcaattcaattcaccttgcttgtgggggtgytgcagaacttacagaagtatttccagaggaggccacgcctttaaacagcctacaacaaaacatttggcctttggcacttaatgtattgaccatgactaagagcctgggtgtgggaattctatagacctgcattctgagctgtgttgctttgggcaaccatttccctattctgagcctcagtctatcctgaagagggagcaatgctgatagacttgttgtgaagattaagcaagataattaacgtagagtaaatgatagtatgttctcaataaagagtaagatactcttatagagaaggcagaaatagggaagtatccccctgctccctttctttctttctttttaactttcaataacaaactctacagagcacttacaacataccagattttgggttggatgttaggtatttataaatgaagcaaacagccacatatgtgggaagcacagatcttgaatgagtaattactcagtgatgaggcagttttaggatggggaggagtatgatgaatatacaggaggaagatttgttggtgcctgggtggcatggggtcgtcagacagacttgtcttggggtaatatttaccatgatgatctttagagaatacccctaatgcccagagtattctcccacactctgtacagccttagccaaggttctgagagactctttccatgcctttgagcttttctcctttgtggatgttcttcctttctgggatgagattgaatgagtagatgagaagaaaaagaggcaatgaaaaaaatagacatcaagcttctgggggcctatggaacccttttcacatccagcctagctgcaggaagatagggtgcattagaaagatcagctggccagggttccagggatggttccgtaacaggaggaccatggcaggctcctttcctgctgcacctcaacctctccctctgtgcagtgtgcccagacacactactttaaaagggctcttgcacgctttcattgtctagttctatgtgcttatagcattgagacagacatacgctaattatatgtagattgtgtgcagaattgcatgtggccttcggttttgccacatgggactatatcccctgggatcatcctctagtcccacacagatggtgctgacttcagacaaattagcaccattttttttttgtactatgcctctatctttatggagaactgtgaggaagggcagtgtggagacgtgggggttcttttgtgtcctccagagaacagcattgtgtgtcctgtatagagatcctcagaggagacagaacctaagcatgcaagagttgcgaatgacataaggcatctaattccaatcaacacatatttttgagcaccttctccttacaaggaaccattctatcagtgaacaaaagagctcttaaattctagcaagggatcatttttatccagacccctccttttacagagaagggaaattaggttcagcagcataaaggaggtggtatgacttgtcccaggcaaggttacctgacaagtcaagctcagatctctggtgccaaacttctggttctgagctggtggtacaacgatgcttccctttcagaccctaaaataagactactgttgattaagttatrttcatatagaaataaaaccccattgccaccatacacccccaaccttattgaagctcggtgattttctttcactacttatactccaggtaaatatttccctctgaacttgtgaagccgctgcttcaaggttctcatttcccttaatgtgtttctttttggttccattgaaaaccttctctttgcccttcctctctgcctcccatggctaagccaccccttatttcttaactcttttgcagaatctgccttttctcacttcttcccccttctctcaactgcaaacagaggtggcctgagcctgggtcccaagccccgrcaaggttctgaactgagagcaccctacagatgtgtaaacattttaccttgctaaccaggctagctgccttccaaaggcaacaggaaaaccagagactgggagcccctggcaaaataaaaacctgcagagagagagagacagagaaagagagagggaaaaaggatcttgttttagattttaattttctcattagaaggccattcattttcttttcatgagggatagggttagctgggagagagagagaaggtgagctaagaggtgggaaggacatgaatgtcatggctccaggaacctctgctctcaactggttccataacaggcagcaacagatagatctggcgcaactcacttcaaatctggagttggatcttaggcttttgaaggagtcagtggggaggcagcttttaatatgtagtctcatgatatcatctaagctgacgggatctatgatttctaagaagggtttgccagtgggtttgaggaggacctgggcttttttgagccttccttcttgatatgtcgtgcaagatgccttcagggtaccctctctttctggcctttctattttgtttcccgtcatttcctccctccttttcatcctctacatcacccctgaaccctccagcatcttaacaatgaactctcatttggacagccgttgtatgcggaggatgtcatattcactatgtcttttaagtatgacaatatatttagagatacagatgaaggaattaaggcttagaggtgaagtgattttgccccatacgtacaactagtaactgctgtcatcaaaattcaaagtaaattaccctgagtgcaaagatcctgatctttctactttaccaagaatacattttattctctgattctccctgtactttagtcacagagacataaattaatgcctttgattctgtttgtccttaaaatccctaccctttctcgtctccggctctatttagaatcattcccatgcctgctgtagcaaggtgctggagaggttactggaatgacacagacacaaccattgctctcgagaagaaaacagttcggcagagaggggataatggtgagaacacaggcaactccaaaaccgaagagcacatgtcaagtttcctaaaagtaaaaagagttcaaagaagagaataatcactattcacagggaagtcaggatgaacttcttgaaagagttaccttgcatgctagtcattgggaaatctagaataaagaaaatcagacttggacctaatatrtgacacagaaccttacttaacccgctcctttaccagatagagaatcaggacccagaggacaccagaggaggcatttggtgcttcactaaggttgtcctgatggtaagagcaggatgactttgtaagragactctggccatttcctgaaaaatggctgagcaggaagtaggaggagaggtgtagattggcatagatgctggtccaagactgctggccatgtcagctgctgacaaagagatttacaccaattctaagctcccactgcccacagaggagtgaagactgtgtgggcctcctctattgattttgctggaagctctccttgctcatttgatgagcacttatagcaggtgaactcccagagttatggtgactgcaacaattctccagctgagagtagtcactgtccttctaaatgagcatcttttattcactctcctctccctctctttcttctcccacctggcctcatacatcatctgacacttaaaatacactcttaattagaaagtcctcttccccatccaacagctttgtctatgccagggacactgggtatattccagaaaggctaggaaatgggggttggtgagcataaagataattagatccagagagaatctgctaacctacttcctggggttcccagagtaactatagagatgcttggcttggaacttcctcaaatattgaactcaaatttgtgacatgccccaggtaggtggcatagcccagatgcctgatgattttggtgaggcagggggagctgctatagaattagggcctaggacagtgaatccaaggatctgatggatctaggatccacttaccaagcagttgaccttcaacctgtctctctatctcctttaacttccatattctcaccagttaagtgagaaacgtaatgtcaccaccttagggatattacatggattaagttagtgcatatacagaccttagcacaatgcctggcctgccatagaggcttgggagattttgctcattattattaactattatgtaggcatacccaatttatgttaagaaggcactcattatakgtgtgtgtgtgtgtgtgtgtgtgtgtgtatctatatctatatatctatatagatatatagatatagatatagatatagatatatatagacagagagagaggcatcagtgtaagaagaaagctgaattgggacacaggggaactgtcaatgactctgtgacataacaaatgccttccattctctgggactcagctctctcacctgtcaaacaaagggtttggaggtgatgatctttgaaaacctgtctagtttagctctgaagtgtgttttctttctttggggataaatggcaagattcctgttagagaatgaagttccagcttttcaggtcctgaccctcacttttatgccccaactttcctgacaatttaatgccactgatcatttaatgactgctaatggcagatgtacactcaaagttctggtaactatggtagggacctcccttctaaatgagcatcttctgttcgttatcatctccctctgtttctcctttcacctcgtatactatattacacttaaaataccctcttaattacaaagtcctcttccccatccaacagctttggaaaatggttttcagatttttattattattgctgctgttgttgcaacaacttcattagatgaagtaccctttcttcaaacaaaaatctttcttgtatgcttcatattcaaaaccaataaaagttaaacttcatgggttaaaattgtgatgaaaatgctccaaacccaacttactcattctctcagctcctccagcccttgccttgccctcgaggtggtcccagaggcaccattagcaactcctaggatcccacagagcagttggaaagcgatgagtctaggataacctgatacaaattttattagagaaaaataacttaaccccccctccttttccatcctttatttattcatctttctcttttggggccacatagggctgtatgacaaatgttcttatatctcacgtgaccgaggatgggtcgtgggcattcacaccatcagtgaccaagacaacaaagacccacgctactttttctccttgaagacagaccgagcccggcaagtgaccaccatcaatgcccaccgcagctacctcccaggccagtgggtatacctagctgccacctatgatgggcagttcatgaagctctatgtgaatggtgcccaggtggccacctctggggaacaagtgggtggcatattcagcccactgacccagaagtgcaaagtgctcatgttagggggcagtgccctgaatcacaactaccggggctacatcgagcacttcagtctgtggaaggtggccaggactcagcgggagatactgtctgacatggaaacccatggcgcccacactgctctacctcagctcctcctccaggagaactgggacaatgtgaagcatgcctggtcccccatgaaggatggcagcagccccaaagtggaattcagcaatgcccacggctttctgctggacacgagtctggagcytcytctgtgcggacagacattgtgtgacaacacagaggtcattgccagctacaatcagctctcaagtttccgccagcccaaggtggtgcgctaccgcgtggtcaacctctatgaagatgatcataagaacccgacggtgacgcgcgagcaggtggacttccagcaccatcagctggctgaggccttcaagcaatacaacatctcctgggagctggacgtgctggaggtgagcaactcctcccttcgccgccgcctcatcctggccaactgtgacatcagcaagattggggatgagaactgtgaccccgagtgcaaccacacgctgacgggccacgacggcggggattgccgccacctgcgccaccctgccttcgtgaagaagcagcacaacggggtgtgtgacatggactgcaactatgaacggttcaactttgatggtggagagtgctgtgaccctgaaatcaccaatgtcactcagacttgctttgaccccgactctccacacaggtaagaccttactgggctaaagatgcccagttgaaagttgaacttgatgtcctccatattatagataaggcacctgaggccagtgggtgatatggggattttctggttcaaccagcagcttcatgattgaggcaagtcttttactcgggtcattgtggagaccataggtaaacccagtttattataaaaatatttattgagtgcctaccatgagtcatgagggaagcctgagagccctgttttctcaaagagcccagagttcaaattgagtgatataagctgagtacaaatagctgttgtattgtatgacatagagtgggtgagagttgcacagtccaatatggtagttcctagcaacatgtgcctacttaaatttaaatcagtcaaagttaaataaaactcaaaattcaattcctgagtttcattagccacatttcaagtactctagccacatgggactagtagctaccatactggcaaagcaatatgaaacacttcagtcatcacagaaagttctggtggacaggctcaaagaggtggggtcgcatggggctagaaaacctggccccatggtctcagctctctgtgacttcttcattttgtaacttcttagaagctgtttcttcatctgtaaaatggggagaataatggtacctattttgtcaagttgctctgaggattgatagagagaagacatataaagtacactctcttacagcacatcattaattctcaatagtatgtctgtcattacttgtctaatgaaaggtagtgtgctgtgtttagggagtgccctagatgatcaaagagaaaaagttgatttgcagcttgactatatcagggaagccttcttgagagaggtgacatttgagcaaggtcttcaagaatagctctaatttgaaggatgttagaacaaatctagagatctaatgaacaacaagatcaatacatttggtgtaatagaacaaatctagarggctaatgtatagcatgaggactataggaaataaggttgaactgtatttgggatttatgctaaataaccagattttaaatacttttggcacaaaaccaaaagaaaatggatgacttaagataatggatatgttaatttatttcactataataaactgtttgctatctatatgtttcccataacatcatgtctaccttaaatatacacaataaaatttacctgaaaaaagaataggtaaaattttgacatcagaaattgggtggaggaagaagggaggacactccaggcagaaggaatttctcatctactgctaaaaagaggacagaaaagggggccttcagtctaatgcctcacttagcctctgccattgctgtcagttgcaaccagtaatccaaaagtagagcccaaaaggtgaactcaagggtaacctgtattaaatgtgggacctggaggaactagattcaagctggagagaccatcaatatccactttcttgtttttcccagattcacactgaacttttctattctgtccaacacacaggaccctggacttgctgatggctcgagcacatttgccgacctctgcaggttttctgctgactcttctctttatgtctctctcaaaagagcaagggcctcccgtgcgtgaacaaaatacctatgtgcaaaggaatgaggatgctggcaggagaatgccctgcctggcagcaagtcagaaagcacctcagctcagcttcccggcaccaggagggcccctggactctcaccttggctccaagacatgagcagcccatgtgaggagaagccttggtgtgtgaccagtctcttctaggtcacagtgcattgtcatctctgctttcacttgggcctttccaaaacttggcaagggagtcaacacagaggttaacattcacatttgactgatgggaaatagaggaaacttagagagtggagtaacttagctaagttcatgggtcaagaaaatcattaggctaaatcacaagtgcaagtctatgatcagtgtgctccaccaaactagactcccaagaggtacctctgtgcctggtgagagtgggcgtggggtaggatgggcataattggaagtcatccattcatttgtacatcgatttatttgctcattcattcactcattcattcatgcaacaaatgtttatgcagcacctgccaagtgccaggaaagtggatacccttagccctgttttgctttgaaaatttcaagattcagaaagatgaagggacttacctaagctcaatctgctaataaatggatagcttggattcaaactcaagactactaggtccaaacctcccatggaaggaggatattttttaatctaaggaacaataaggggcaaaattaaaagacaagtgatagggagagtggcgctactaaagttttggggaaaaaaactgtgtatcattgagacaggatgaagagcagctggcctttgcagagcaccatgctggtgtggaggggccatggggccccaggttccagacacctcacaatcagcagacagcactggcaggttccaaaggcctcctcttttctaagtcacgggaatgcatgcccagagtgtctgtgagcgaccatgagccagctataaccgctgtgaccagggcttgtttgtttgctagctgggaaagctgtatgccctgggtgaggcccaccaggtcacgtgtcatctcttggtgaggctgggattttctgggttctggccgattcagctctcctgtgtgcagacagaaacctgtggaaggttgcagataaatttttgctttgtgaatttaaacaaaaaagggaggaagggaaggagggaggaagggaaggagggagggagggagatagggagggtgggagagtcatgattacatggtcatgacacatacacttcaagctctgaaggcctatcctgtgggaaagtcacagaattattctatatggtttctaagccatggctgkgactacagtgttgcaattacaggaggcagctttgagctgagtaatagatgatatcayctccagtcagaatggtcctttttggggagggctttgtctgtgggtgagtgagctccccttcaccagaagcatgcaagtcagtactgataaccatgcataatgaggccataggtgggattacagttctggtggagacggtggccttgtggtcttggggttgagcactgcmcagtaatatcttattccatttcatatcagaaaaccaaatattgactgcttctcttctctttaacaggcatttattgggcatgtctatcccaccagcctttctgctcttcactgggggtgttgcaatgagttggacatgttcctcaccattaaggggcttccactttagtgggaaagtcatatagaaacataagaaactctgatttgtaaatttagagacacacagtakgacaggagactgaaaaagcagagatttatttgactaggaaaacaaggcaaatcagctggagggggcaagatttgagtaggcatttgagaataggcagcctgctgagaggtaaagatgcagactccatcagtgagggtcctagcaggaaacagatggcacattcawacagaataattaaggagaattgaaggaggggctgttttcaaggagaagctgtttacaatgttgtaggcaggattaaggacaaccaacaaggccttgtgctatactctagggcgggcaaccatggagagccatttacccccttggcctgtaggggcaagaggagaaagtggttatgggacccagagagagggactgtatggaggggatttcctggcagcagctgtggctctcagcaagggaagcagccaggctacagccacctgaccagaagggaaccaggagagtaaattccatgttgtcattctctctgcctgccagtctcctgccagtgcttcccatttggtggatccaactgaagtcacaaaacaaaggaacctgttgatgcaatccatagatagccagcctcccaaggacacagagcagggtggggagtggacctgcattagcaagcagagaatgtccagagcctagagacagccagcccatgcagagggtagggcataagccaggcagtggagagggtgaggagtggtgtatagaagagagcrtggagtttaaggggttattatggctgagatccagaccatgagcagagaaaagttcagtttatctcacggaaaactttaatgttaggcttaatcctctgttccttcctccstacattcttcccaccttcccttccttstgtccttttcttctctcaataaatatttgttgaatgctctctctgtgccagcccgatcactgccctcccagagcttaccacctagtgggtaagacagagaagtcaacaccccactgcaatcactggtgtgaatgaagggtccacagtactagccaggaggagcagtctgtgtgagcagtaaatgcctttctatgagactagccagttagaaaaaagacattccaggtgaactgtggccattctctacagtggtggagaatagccagggasgcaggacttcatctgcagccattagagatgtctccacgcaggtagaatgcacttcacacacccttttataaatgaaatggaaaacctggatattaatagaaaattccagtgtcaggaaatccaggggcatttgacactgaagactgtagctacctcactgagagaggatattgcagcaaaccaaccaagttcctgtttggacccttccaaaccctggcaccctcaagtgaactcacctttgttcatgaatatctactcatacaaaatgggatgggtggaaaaaaagacactttccctatacactgttgtctcataaggaaacatttcctttgtcttctctttattattatttgggaattatttcctttgtcttctcttttttattattatttttttkaatgtaacaaggacaatcccctgaggccaggtttttgttgttgttgcttttggactccagttaatgttgttggaagtctcacaaaaggggctgcgataagtcttgaggtcacccccgacccctctgctggcagctatagcccccgttagcctcttcccctgctctaatcagggccactgaatgatttgtcctctctgggtggggtttcctacttaatttctgatttgatctcatggagcataaacttcatactttcctcttccttttcaatctgaatgaaggactctcagagcttaatggatcagtagatgggtccagtactttcttgctgcagatggggagactaagccctcaaggaggggcagacactgacgcaaaccatccattgagaggggggctgagctgcgatggagacccagggtctcacttcctactcccatgctttttcaactacaccctatagacaccttagacaccagcttaaaacctggaaaggttacatttagtatgtttatgttcttacccatcatccacattccattaagacaccttagtatccagagaactgtgataaatgctgtaggggtccaagatataatctctgtcttcaaggtgcttgtatcctgtgattcaatgacattttgttacagtcattcaagagaaggcaagagggcagatgactaatttccctgtaaaccacatagcctataaggcttccatgagctctgagaaagggcaggatcactgtggtttggagaagttaggaaaggtttaatgatggagaagggatgcaataggcttttagcataagcaggctttgtaataatagaaaagagctggtgggctggccagacatgtagtgataatagggtaaataaattgaagtgggaagatgttgaggagatgcaagaaagatgtgagtctggttggggcttcatgaaggtagatgccacagttttttcttcagactgtagacactgaagactcgggctgatttagaatgaaagaattcaggtgaaacagattctagcctgggctgggcagtttgttagctatgcaatcttgggcaagccttttaatctctctgagcctccaattccacatctatttggaaggaataatagtatctgactgcytggatcacacaattgccatgagggtctcataaaataatatcccagaaagagttctgggaagagttaaccagcatgcagatgaaagggggcattgttatttttcrgtcactttgttcattcttttccagtaatcatgtaaaagaaattgcttggaattttataatcagaatatcagggtttatttaatgtgactaatattcattaaagcaataacaggagtcaggtctggtgtagtggaaaaattatgcgtgctagagactgaccagggtttgaatctyggctccgctctgcactagctgtctgaccttggcacattgctcagtaagagcygctggtttctcatctgtaataattgggtgatagcagctatcctgtggcatgtcatggcactcaaatggagtcatctgtgtgagacacctggtatggtacagtgcctggcacatggtaggtgatggagaaaagtctcctccattcttgtgtgcacatgtggacaccatatcctccctgtcagcattgttttacagagactgtgttcctacaggctcataaaaaaaggcctggatgaaactgccatatacaaattgagagcatttgctgagattattttcgttctcaaaatattaactttttttaaaggactagccacagaattggtatttttaaataaagaccctataacttctatcaaactcattgagttattgaatttgcacactgrcttacttttaaaatgacccaaatgtctggcagtgttaaaggacatatttctgtacaaaaccattccaggcaatgttgggatggctcataatgagagatatgccagacttgtgaagttactatatgtttccaccatctccagccctcatgcctgcttgagggttgatacacagacatacagattcaggcatactcacacatatggtttgattttctctgattcagtctgggttttcttcatgcttttcttctgaacaaagtccacctttactcacaagttccatctgtgagacttgcacacatataactttggtcttaagagcagaatagaggggtgaactgaattaaaagaagaactgttcaaggcccctaaagatgaggttaataaggagctcgaaacagtgacctatraggaacagtagaagatcaatacagtctagcaaataaataagaatacaagttttggagacggaacatactacagtcaagtcatttaacagttctgtaaccttgcacaggtctcttcctttgtcaaagactcagtcacctcctctgtaaagtcaggaatgaaagtaacagtctagtgcattgggtggtttagaggattggatgaaataatacacagtcaaccttttaggacagcacctggcacatagtgaagtctgaaaatagcagttgttattgctgctgttgtttgggaattkccctcctccgatagatcttctcgcttcttattgtgcatatcccgaaattcttagccccttttcaatcctgagccccctcactacaatctcagtgcgggagtaagagacagaagtaacctaatcaaccactctgtactaccaaaagcccttttattttatcatcctcaggtttcatttttaaaatattttttttaattccaaaagtcctgtataaaccgaatgctaatatattgattatcccaagagataagcagcatgccacactaagtttaagcatttccagcaaaaaagcaaaggcatgtctgggattccaagttggggctcattgaatagtgagtagggaaggaactggaagctgggaagccaggagggtacccataatgtgctcaggactacaccaaccaaggctctctcctggcctgggactcttgccccagcatactctatattctcaaagtttacagataaaagttggaactcctttgcggggagaagtcaggaacatgccaggatctgaggtcctccttctttcatccctttcccaaatgttgtgttccctgtcccattcccagctgcctggatggatggcagtactggtgccctttcaagggcctcagcaggaggcagttggttttttcccaccctgggtttggcatgctcagcactctcattttcctttctgcatccactgatgacactgaccactcatgacagcctctgcacttggtcagatgcccttccaggttaggaaacaaagccgttgggcgtgcaagagatggttgaactgacagacagcagcacattttgttttattgaaatacattttcctaagttggttacagctcagcttgttgcttcaaactcactgctgggcagttttccacctcctgagagggaacctccacacctccactctcactttctgaaaacacaaaactagtgtgtgaacagcattgcattttgttcatgggtttgtttgcataactagaatatgctcgtgttttcccatttttcagaggagcattttctgtcttcctcctttctcctttcttctctttctcttttccatgttctaggttgttttagtggcctggtggtgaagggtggaggagcactgtctccacatcgagcttctgatgtgtttgattcaaaagttgtgtgagttcaggcagccaactgcagctcttagccttgaacttgacttctaactactgaactatttttatggccacagagggcaatgatgattataactccacaaaatcatgaagtaagagagatgcaaaggaggtttctttcccatgagaatccatggtagaaaaacacagtttgccagtggtttggccaagcgtgaggaaggaattgactagattcttccaggaacttagtggccagcatgaagtatgacacttttcttctcttatttcaaattcttcatctgtaaaatgggaggatttgaggtttgttcatgcacacatattctcaaattagacattggaatcctgtttccaagattgtgggaagtagaactagagtacagaggatgggcttaatatttaaaaggtacaaataaagccatgcactggcactggagacgccaagggatataagagacagtctttgccttcagaggattgaccagcccctgtaactacttgagtacaaagtgttcagtgtggtaatgaggagcaattatgctctatgacaagttgaaaaaaaatcctactcatatttctcaagtcccarcagtggccttgtgatggtaccccatactggggcagtctacatgtctgctattttattttcccttaggctccaaatgtggcatcctctttccaaaaatcaatttgaatttatttctacttttgacagcctggcatataatgtcatgctttctagcatcatttctctatacttgaactccttgatcatcacatgactttctaagagttgtctctgtttaaccccaagggagacccaaatttggagaagttactagacttattcaaggtcatccagagggacctacatctactgtacggcctgtattgttttaattttaaataaatttgttttttgcctaaggttaggtgatttgtatgggactatggtccagattaaaatttagacattgccattttaacacatattggtgattatataattcttgatttatcctttctaaacttagtatattttagttagtcttcacatcagttatatgcctacatggctaaagtctagagccaaactatgcagtcttctgaaataacccttgttcctaaaacattgactgctgcagctcatgaaggagatgtgattgtctttgcttagttgtgatttaagcataagacaaatcacagggctgttagtaagttgtgcatattcactcagtgtggtcagttgtgttatttatcaatttggtttgatgctccaagaaggaagtgaggtggtgggaagagagctgtgggcccttgaacggtagagttcagttgcaagaatgattgtctgacatgagataattgtattactactgtgttgcttttgaacacagcatcacaattcaattgtgcacctccttacttagcaagagattcctcaagccttaatggctgctctgaaaatatatgaactcagagtttctgaggctgtcaaaacagagattggagtaccccaagagaagatcttagggaagtgactattcatccaatagtttgtgcatgagtgtgtgtgtctgccttctatgtgccaagcacagtgctaggtgctagaagtacaacattgaacattgcacaagacatctgtaattctgcccttttggaatttcctgcagcaagataaatagctagctgcataattgctgttacggagaagtccaaggtgctgagcgaacacagagaatggctacctgactcagacatcgggggtcagagtagcttttaggctgtgtcctaaaggatgattcgtgttaacctagtgagtgtagctgagcttgccaggaaccaggtgttctgacactttgctttctgtcctaacaatctctaaaattattttccaaaaggtaaatgagaaaaatagcagctgtgtagtttctagtaaaatgcattcattgtaaagtagtgtgctttattctgagattattttttcttttggagtgctactcaagtaccttttattttatgatatgagggacctcatacatggtggagtgtttttttttccccttttgaatgctttatttattcatcgaagttacacaaactgctgacttccatctcaatgtttattattaggttgctgcagaagtaattgtggtttttgccatttaaaagtaatgttgaaaaccgcaattacttgtgcatcagtctaataatatcccaaaagtctaagaaccttgccactggcacactctgcttctctgaaccagcacctggtttcctctgaaccaaattctcaggattctccaccccacccattacctggtcccatcacgatccaatccacaaggagctgaaggccagtgattttcctatgggttagccttccaagagactcagcaaaggacatgccgttggcagataaatctctgcatttagagcagcaataaagggggctttgatatgtagtgtctgtgactgataaaagaaaaatactacaggagacaaaatcagaaaccagaccaacatttcagcttccctcactcccaccctaactcagcatcagatttttccccatgtgtgaataccactacttcttatatacattcctattgctgtgagacactgccaatgcctccttctccactttcaccacctctactccatctcccaaattccttcagaaatctccctggaaaatgtaaaccagatcattttatcctcttacataaaatctgycagggtctgcttgggactcccaggacactttcaattctccattgcctagtatacaagacccttcctgattgtcttagtttgctgtatattgcttcagaggaatacctgaggctgagtaatttacaaaggaaagagatttatttggctcatggttstacagacagtacaagaagcctggcaccagtgtctgcttctggggagggactcaaactgcttcccctcatgcttggaaggggaagaggagccagcatatgcagaaatcacatggcaagagaagaagcaagagagagagtggggagacgatagagtctttttaaccaccgactctcaccggaattagtagagtaagaactcactaccatgagaatgacaccaagccattcttaagggatctgcccccatgacacaaacaccttccactaggctccacccccaacattggggatcacatttcaatgtgacatttggaggggacaaatatccaaactatagcacagatgtagccattgctgtcccctccagcttcatcttcctcaaccttgcaagtgagggcttgtaatgtctcttctcatgcttctatgcttctgggctttctggagcttctgccattttctctatttcccacacttggttcaatatcaaaccaaggtttattctttatgtgaaaacctcagtggcttctgaccctccttcagctgggtgtcattgctgtatgctctcattatatttaacacccacccactctatcataacacatataataacaggaagtaagagactaatggctaaggatatggtcggtagcatccaacagactaggggttgtgtcccccctctgacacttttccaagtggagggaccttggaaaagtggtgtcagccctcttagccttggttccatcacctataagttggggatactctagggcttttgaaaagcttcaaaaatataacaaaaatacttcaacagttccagtgtgtagtaaactttcccaaatggtagtgttattaatgttatcatattatgttgtgatctttcatttattcgtctcactttcttcataaaacttctaataccttgataatgaaaatcatgctttttttcattgtctgtaggcaaagtttctggcttaaacatggtatttaatagaatctcagtaagtgttgttgatgaatgaaagcagaaaagaatgaatgaatgatatgtggaaaggaaagaaattagaaaggaagaaaggaaggaaagaatgaaagcagggaaaaagaaaggaaaaaatggaggtaaggaaagaatgactcattcaataactaaataaaggaatgatcaattttcaattagtctttgattgatgctattatgttacatgtcaggcttccatacaaaatctgttattttggaaactaatcattcaagattccaagaatttaataaactctcccagcattttctttctgtgtctctttttatagactggagaggcagatttaggtatttttgacaatgaaactaagcaggaggatcaagtccagattgttagggcccttgggataaagaacaaaattcaggtttttgtactggtcacagcttggagaaagcttgttatttggaacaaggatatggatgcaataaacattctgaggtttatcttgctttaatgacttgccttaagtggctttgatctttatatttgataatcattttcaaatggtctggtgtgttctgaaaattaagtagcggttcatggacttgagaacctccttgggaatgacaagctacaatcagaatttggaaatgggcaatgttacagaatttgctctatgagatggagaaacaggacaacctcctgtgaagaaggtaaacacattaatccagtgttgggaaccargtttggstggtggarcgggaacccaacaggcactgggarctaaggscagttttctttcaatccatgaactagcttaaaacagaattctgcatctcgagggtttttcatgarttgggtactcttctaggcatttccttgtgcattacctccttgaatttttgtwtcctcctttcttggttgaattttctaattcccatttcacatgtgaggaaattgagataccaagtgacagggtcagttgtccaagatcacagagccactttgtggaagaaggaggatttgaacgccagtttgtctctctcttaaaatcaccctctgttgccttttattctaacctgaaagaactgtttccagtctctaggttgcttaaaagtggcccactcttggccagtgttcagctcacacaaaccttcctccagttgagggcatctacgcatggccagtaccatctctgtgaccagccgcacccatcaagagcccaggaagcatgactctggcgtgacattgcttaaagatctcctcagctatcacttctgcataggggaagtccactgaagagtgacctgctttgagtgggaatagaaattgagagtcctcagtcttgatctgggctcactgtaagctgtaccattgaaacgggaaggccagtgtattatgcttctacaggtgaaaacaggccttctcacacttttttcccatgattttatttaacggatttgttgttgttgctgttgttgttttgcattttgaatgtggttcccttttgcttctctctcaataaaacaggccctgacagccctctcattcagattattacagagttgtgccatctcaggccagtgcatttaggaaatattttgttggcacttaccaacgagtgagatgcataaagaaaatattctaatgacagttgagttgagagagctttgatctccctccagaactgcactcatggctttgaaatgcagttctggcaaaggggtaaagtctgggcgccttggcaatcagggctgggctccctgaaatagacattccaggggacccgcaatctcaatagtgggatccaggtgcatgggttgtgtaggaagacaagagacactgagttaccactcttgagaggcggctcaggggaaagtttctaaatcaggagggacatttcaatctagccaacattttccaaactttgttstttgtactgctgtttggtttttggcaaaggtggaagtgtgtaaggggaggggtgtggargaggaattatggtcacatrtttytgggtacacttcctgtgcyatctgtcttactcttattttgcatatttgaggctccraaaattcttgcaattaaaaaaatatgtatttaaccttgtttaacagaccatgtcccaaatccatttgactcagcgacatttttctttaaatattcatcattttcttacaaatttagccctctgtagaccatgatctggaagacattgatctatttcacaacctcactgaacaggtacggaccctgagctgcagaacaaccagcagagtatagtgagaagtggtcagatattcaggcaatgcaggttcccacacccaggtgtccagctgagggagagaatggaggctgccatccttcccatgatttgttctctaaactttgcagggaactgtgtccacctgaaggaagaaatgactttacttatgatacaaaattgctgctatacacaagtgacatgtacacaggttagagcagagaggtttgttggcaggcttttctacaacctgtattagatatatgaccttgggcaagtaattccctttccttgagctctggccttgctcatcctgttttgaaactatgtaatttgagagagaggtgctcagtagctgcccatcggtggtggttctctcttgaaggatacttttaagtgatacggagataataaagatttggtcccaactgccagaagctcattacctgatggaaaagacagawgctcacacagtgaatataacccaaagcagattgataagtactggaattaaaagtagggggcacagaggaaggaggactcattttcagatagaggtgatgatgatgatttgagtgttgttaataatttttgttttgctaacaataatgcagtaaaaggagcctatcctaatcagtgatgccttctctgtgccagtcaccatgctaggcacttaacccgtgttgcctctaatccttatgatgcccctgacaggtggtcatcatcatccctactctacagatgagagtggtcataagaggatacatggagtgcatcacatgtaagctggactttgcagggttcataagatttaaagggccaatcatcaggaagaaagattgcaaggcagaggagggaaactaatggrcattcttargggttgggcataactggggaaaactagaggttctcagaataagaaaaccaagagaacttgagcggttgaggttgtagaaggaagaaggctgggtaatgaggaagagacactgaragctgagactgggagagccacgcagaggcagactgtcagtttaggttctttcccagcaggagaaaataggagaccaggatatggggggctcacattttctagttatgtgctgggactgtgctgagctgtcttatttaatcctgttgggatccgcatgagctaattgatactcagagacttaaacctacttgtccacagatataggtctatctgtccaattctgagtagcaaagcttctacgcagattaagccacacagattaagctacagattaatacacacacagcttaatctacagactaatacatgcacagagktggacagacaacttgcccatagatataggtctatctgtccaactctgcgtgagtctgggattttgattgatttttctgggaagtgagtaatgtttgtttgcttttggttttgttttaagagatggcctattgctctattgcccaagtgggagtacagtggtacaatcatagctcactgcagccttgaactcctgggcccaagcaatcctcctgtctcggcctccgaagtactgggactacaggcatgtgccaccatgcccagctaaattttttgaattttttgtaaagatgggatctccctgtgttgcccaagctgatctcaaactcctggcctcaagcattcctgccgccttggctgcccaaagtgctgggattacaagcatgagccaccatgcccagccctgacattttaaagtacatttgaccaatttacgatgtatacacagggacagccttcccaaaaattgcaaaatgtaagtcacatggccattttccttctctcaccttcactatccctagacagtaatgttccttctaaatttgacctcctgtgctttctcttctatcttgttgacaaaagtgaaaaaaaaaaatcctttcaaggcataggggtagggaggtaaatacccacatggactcctgtcccaaagattttccccctgatatatttgagagacactcagcctggctctgtattagtgggaatacctcgggcagcaaaaggaaaactttcatccacagagctgtgttgttgctttttttttttttcccccctttgggtgggttcccctaggagaggtggggaagagagaggcctggattgctgctgtggagtcttcccccttagggaaatggaggcttcccaaagtatgaaaaaaaaaatsacatacaagccatgaagaggctcccacatcccacttctctgctttgggctaggatgaataccacttcttgaaaagattggcttctgcaattaccactgaataaacaaccaattaaaatgtctcccctgcccctaccccaccctttttctctcttgaagctttctcatctcagagctatggggcagaggtggctttctctaataacatttgtgttctctgcctgagagaacatttgatggaaatgaacaaatcaattagaaaataataaattatgtggaaagggctgatccaagaaaatctcagctcctctgtgttttcattctcctcccatgcattgtttctcttttcactctgggcctgggtgagcttggaaatgagggtgaggttgtgggaagygttggacacatctagatttgtacttggccttgtctccagttgtgtgatctctgaacccctcttccttcatctgtatgatggcgataagtgataagaatagctaaacatgcactgaggctttctacatgccaggcattattctaagccctttacactctctttattaactaccttaaccctctgaacagctgtatggggtaggtagtattatcaccctcattctttatataaagaaactgaggtgcaggaagttaagtacattgcccagggtggcccagacataaagtggaaaagctggattcaaaacctagggctgtagcttaagaatgagccatctcacccactctgttgcattgcttcaactaccaaacagggatgagacatgtgtacctagcacagggtctggcatacagcaaatgcttaataaatgttggctgtctccttcctcgttctcttccctgacgacagagcagactgattagaattcctcatgagatttccagcctaagaagttgaatgtgggttcttggggaagagaagggctcagcagcgagatttcaggtcaatatctgagtttgtgtggctattcttggaattagtcagctacacctagacataaatgtaagctctcctgggcccacctatctccaactcatgttttttgtgaaaasatgtacaaattatggtcacaggaatgtttggtttygtgagcttggggctttctgtgacatgggcggccttgacacgctagatctcagacgtatcctattcacagcagggtagaggtgtaggttttccacccatagaaatgatctgtggagcatcaggcagctgttactaatttcaatgtattgataaggaaactgaggccccattagtcaggaattattgaatttgagactgagagttaaatatttttactcttactttccctaatttaattcaattccatcaaaatctactgagggctcaccaggtatcaagctttgtgcggagaactgggtaaacagagattaataaggcacctcgccttcccccaggtggccacaagtgtgtattatgtaatagaaagaggaagcaatttattgaaatggcaaatgagagacagtgctctgctagtaggaggtggacgastatggagatgttaaaaggggtgcaggtgaggagagcatcagggaagtcttcctggaggagggataccagaacagactttggatttgttcattagagaacaaaatgctgatcagagtcccagcagaggaaacagcatgaataaaattgccaatgggataatgcaccgtacagggtacagagatgttttctgtatgcagtggggtgctcaagaaaggttgtagagatagatgaggctaaggagtaggttgtgtcttggaggctatattgggaacttgaactttgtctttcatacatggggagaccctttattattctaagaggggaagagcaggaaaccatcactaatgtgtgctactggctgggctctgtgagaactccttgggagagacagcattaagaaaaaggaaaacattgctaagtagcaacttgaacttagtaaggtatgaagaaggttctctaagcctctggagataacgatactacctacctctgtgttcataagaagcctaacaactttggcaagtctctaaaactctcgagaacttaattttatgatctgtaaaatggaatcatcttacttataatattattgggggaattcaataaggtagtatttttaaagtgcttagcaaaatgcctggcactcatagtagctctaaattatttggagagggcctgttatttaaatagtatctttttgggggcatgataacagccaaggttctttttctgtttcagagcctacttggatgttaatgagctgaagaacattcttaaattggatggatcaacacatctcaatattttctttgcaaaatcctcagaggaggagttggcaggagtagcaacttggccatgggacaaggaggccctgatgcacttaggtgagtcttagaaactccttcaggaggcaactagagtaggacagtaatacacttagtgcgatgatgatcattgttacgatcatgatggtggtggtggtagttgtgagggtgaacaaccgatttatttatcactttttaatttacaaaattctttagcatcctttatctcattttgaccaccaagcaattttctgaaggaaatagcaccatattattaaccatgttttatcaatggggaaatgagacccagagaggaaatggggcttatccaacatcacacgcaagacagtgacagtcacaattggaatttaagtttccaacactgcccattgtttgctttctccttataccctctgtctcctagttcctgcaaatatcttctcagtctggtaaccacactgtactggcacagccagtcatgggttggcttaaaagacaccaaagaggcaagaaaaagtgagtttgcaagaactctgtgttcctccatgttccacccaccaacaccaacaggaactcttcttacattcaaattatacatatccataaacaaracataagtttgtacaaaccaatcaccaaaagttagacatgacaacagtttctgaaccaggccctgtaagcaaacattgcagttctttaattttattttttccatgctctcttccaggacacatctatatgtaaacatgcatttttttaactgtacatttttaaaatcatagcatagatgaaattctgtgttcttttttcacttaatattatgctatctactttttttccatgtcgcagaagtcttatccttaacttcccacccatatttttttcacttaatcacaaaagaaaagcacccttgtgggttattttcccctctctaaagccaagatttttaatagccacataatattcccttgaacaagggcactgccatttatttaatcattttccgtttggtagaatgttcccattatttacaagaatgaatcgtgatgactcagtgaacatctttatctgagaatgttcaggctcagcagtgacagtgctggatgtatcctcaggcctgcctggtctcctggtgaaacagagtccagtagcttctccattgctattctgtcttggaaatgagagatttaaataatgcaagttttgctcaatgaaaccatagacttagttccctccagacgactctcatttctcaattgttttttagagaatgaaaccaatttgtgtgtgtgtgtgtgtgcgtgtgtgtgcatgtgtgtggttgtataaataaagatagatacaaagataaatatctacttgttctcagctgggaggattttatgccccaggagacatttggcaatatctagagaygtttttgcttcttacaaatgggggaatgctactggcatctagtgggtagaagccagtgatgctgctamatgtccacaatgtccactacaaagaattatacagactaaaaagtcaatagtgctgaggttgagaaatcctgagacatatgrtgtatgggtagatagattggcagatagacagacacagacaggtggggttgggcagaagagagcgtgcagcttaggcaaacttgaagatgatcagcttatatcacatgcctagtatgatatatgggagtaatgctagactagagccaaaattcgtgtttgttctcagctgtgactttacttagcagtatggccttaggcaattctctttccttcctcaggtctcaatgtccttcaatattaaataagcaggtcctaggaggccagaagaccctaaggatccttctcagttctgaaattctgtcctattagaaaagcaactgaaagggccatgatcagagtctgagaaggattgagtagcaggcttctactgttagaaaaaactactcctgataattccataaatttcagagtctggctcagggccaggaataagggaggctataaatccatagcatgttatagtatttcaggatgatgtcaggctcaagctatttcaccttttaagagaagcaatgaaacaggactggggcccaagtgctgtcactctgtgaaaaggggtgagttgggaggggatgaggtaaagcaaacagggctagcctagacattaagtctgcaatccaatcatcatccctggaatggtcctgtcctctcattacctcaataatgaagcttcatggagagacagagaatcattggcattattgtagctgcttattttagagctcaccagagatgcaaagtccattttccacagtcacaaggccagtgtgaagcagaacaaggattgcaacctatgtcagctaactccagctggactccaggctgccctctccccatcccaagagatgctgctcatgagtaattcctctgcagtagccccaatcaaacccaatttattacaaccatatttttcccctctttttctgctattacaccatgatccctggaaaaagccttgggtgggaagcggattatgtttcatgttatgattgacagaaaataattgagaaagatttcctgtctcaatttytcttcytccctgcytctgcctgccccyttctcawacccaagtgaatgtgcacacccgcacactcacatgccctctcacacatctttatctttgtgttagaaagctctaagcaattcaaaattgctcagaaattcaatctctgaaattaagtcctccagtgaccctaacacggagacagagtccttcttcaaaatcagagacctctgcatagactctatgagtcccttgactgagcaagcacaccattccagaggttcagtctaagataaaaccctccatgcccatgtggggcttgccagctcaaatcaacaagaccctacctcctcaccattcttttagaagatgctgctctacacctaaagtacctactttcaaggttcacagacctgagttttaaccttcccttaaacattttaaaattttaaagtttaattatytytctggcagcctgtatgcatctttccaatgcctaaaatgaacacagcacaaatactacccataaattctgctgagatctgttctgtctatctgcccaagccaagcaattctcaatcttctgaggcatgtgatatagaccattgcttctcaaaccagaatatacagacaagtcattcaaggctcattttaaaatacagattgtgcttctgtaggtctggggtgaggcccgagattctgcatttctactaagctctcaggtgatgatcatgctgcttgtcctcaagtgatgtacttgatgtatggaggtgctattctagttctcacactagattagttaaacctcacaaacttctttagataagttaacattcagcaaatattcaacacatatttaatgagatactctgctccaggccctgtgatagtcattaatcatagaacgttgattaagagtcctgctcaagtgacattagctagtatgaaaactgttacaatggtgaatacagcatggtgctgaccttcattagcgttcatgctcttacagcatcagggatgaagatatgagattcagagatgctaattactccactcgatgtcacagagttagtgaaggcaaaatgggaaccagaaccaagatctctgagcctgagggctttgtctagacaagaatatgtagaatatttggaaataagagtaggccttactttgtaagggaaaggttgcagcagaaaggtttactggcccagaaatcagagtttctgaattgctctccattgaaataatttgaaatcaccttgggtaagtcccttcacctctttaagcattggcgttttcatatgaaaaataaaggaattgtacaaaatgacttttgagattccttcctgctctgataagtcatgattcatgccataggttgtaacagctctcagggcaatggagtcctagggtggagaagcttgtgtttattttgggcagcatctctttatccttgatggacttgggggttcttgcaccaagaagcagagtacctagtttgcctgattctctggatttcccctwacaggtggcattgtcttgaacccatctttctatggcatgcctgggcacacccacaccatgatccatgagattggtcacagcctgggcctctatcacgtcttccgaggcatctcagaaatccagtcctgcagtgacccctgcatggagacagagccctccttcgagactggagacctctgcaatgataccaacccagcccctaaacacaagtcctgtggtgacccagggccaggaaatgacacctgtggctttcatagcttcttcaacactccttacaacaacttcatgagctatgcaggtagggccctacactctgtagggtgaacaggtctggatgtcagatgtgggatccaatcctggctcaggggaaccttgaacaagctacttaccatttctaaggatggaaggcctagctctgccacttatccacctaatgtctttcggtcattctctttctgggtttcacttttctcaagaaaatggaattgttggactagcatctccatgatccttcctaaatgtgcagcacatttttctaagctagtggttgttgaaccttttttatttaacccatgtgtcccttagataagcataaaactctcacattctctgttattttgcaagaacaatgagagtgctttggactttgcaaagagaaaattatgacatgagattgagtatgattttttttttcctaactgcatatatcttatcatagtacttttgagtaccactagtaacagtgttaggagcattaggggatgccctgcacttccctttagcatgggatacatcaaggccttggagcccttttagcacctttggcaaattagaacaagacaccccttcctcagggctgtcatagcccttaccactgcacctgcagctaagagtttttgtgttagtcacaatgcacacaattgcacatggcaggccagcatcaaattctgttaccatactcaacttagtgtctttttccccactagaacaagcaaattctatcaagccaaagattgcatctaatacatcactctattctcagaagtcagcacaggggccagtgcttaataaatgtttgttaggaaaggaagaagtaaagaaagaaagggaggagagagggagggctggagggaaggaaggaggaaaatgaataaattctcttataacaggtatataaaatttattcttatcaaaagcaatatttctactcatgtaacaaaatattgtccagaaaggcctttaatatgctctctctcatttaattctcacaacaaatgtgtagagtcagaactatccccactctacagatgacagctttgaagctcactgaaatcatttgcaccaagtcacatatctgactccaagtatttttctcttttactcttgtatttcttctaaagagagctagctgatggttgagtggggaaattgagcaacctgggtggcttttacactctgttccacagggatgcttcagggcaactgccctggtggctatatgagtagggctttaggctctcattcctgctaaagccagggaaaacacaccccctttctgactattttacatttctgttgaggttttgcctcattgcatttgaagagaggaatttgctgctggaacccaaaggtttctgtgatccccagtggttctttctgcttgtccatttgggctgatgacccctgggggcctctccagtataaggttcctgcagtccaaatctgaattgaagtgtcaataacccacctctggtaccataaagagtcttagatttgagtgctcaaaaaagaccagggtgctgggtatttcctgaaaagcagattcccactgggctcccattcccagccaagctgacatcccacatccggtgccccatcccctcatacaacactgctaaagttccatttytatagcaccttttcttggccagctcaacacacatggraaataracaataacataagtttggaagtttgccggcctcttaggggstaggagctgccactagytaccagacccccataaactaaatctttttttttcccctttgtacagatmtaaagggtgattgatttactattttttttaaaggaacccctcagctcagtgacccattaacagcagaactaattcactgagctacgataacaaacttacacccacaaaagcatattcaaggcaaccacgatctttgaaatgtttgttttccttgggatttctgatagatgaggtgacaaaagcagctggatgcaattcaaaatgcagaacaggactgggttctcagggctatggagagccatgcatgggagctctctccatcaagataattgggtgaagacattgctgggtcaacttcttctcgttgctttatcttcctgggtgcttcttcctcaggcctgatcactggtagggtaaaggtttgtggtgcagcactgccaacagaactttctatgaagatagacatagtttatatctgtgttggccagtatggtagccatgacctctactacccatgtggtaactgaacgattgaaatacaactagtgtgactaatgacctgaattatcaatcttattttaactaatttaaatcagaatagccacatgtggctggtggctaccatattggttagctcaggcctgcagtaattcttgagtacgtgtgacatgccggacactgtatgaaatttttcataggcttgtctcattgaatccccacagtagcccaaggaggtgcacaagttttacagatgcagaaaatgtggttcaggtagcttaagtatcttgcccagcwtcmcaaagatwaaacaaggcaaaggtgaaatctaaactcaagtgtttcttactgcagagcctgtgttactaactagtaagtatctgcctcattttctggttgtggggaaggttgagagggccacaaatgctcagatcaagcaggcaccaggcagttgatggggggaagcctaattcagtaggcaggctggacagagctccagaggagtatagttatgttgaactcttgggtaactcttggaaaactcaacagataaaagagtagcagacccagttccactttctggagataataggctacaagagttcctggaggaggacactctggtcctcaaaactgcaggaagccaggctttctctagcctacaggagcaagtgtcctgtccccatctttctgtgtgtcatggcttcttaatatgcacacatagattgacccagcaattccacttctaaggaatatatccaaagcaaataagtcaattggtatgcttaaagatttaaccgtaagaatgttcttaatgatatttgtttcctaaatatttattaggcattcactatatgccaggtatagaaaacaaaatgtttgaataattagaaactgcttacaagcctaaagataatgcattgctgaagtgaactgcaaggtattcatgtgataggatattatagggccactaaagatgacagagaagatgtttgaaggacatgaacagaagtggaataacatggtggttcagagcatgaaatttggagtgaggagacccaagttgaatgttcggtgcccagctttgatcttcggcagtttacttctcctctctgagcctcagttatttcattaataccattgatgataaggatgcttgccttgcctgattgtaggtgtaatggtacaagtgaagcacttagaactgttgttgttctaagtgcccattaataatagactggataaagaaaatgtggtacatatggaatactatgcagccacaaaaaagaatgagattatgtctttttcagggacatggttggagctggaagccattgtccttagcaaactaatgcaagaatagaaaaccaaacaccacatgttctcacttataagtgggggctaaatgatgagaacacatggacacacagaggggaacaacacacactggggtctattgaagtgtggagagtggtaggagggagaggatcaggaaaaattgctaacgggtactggccttaatacttgggtgatgaagtaatctatagaacaaactcccttgatacaagtttacctatgtaagaaatctgcacatgtactcctgaacttaaaatgaaagttaaaaaacaaacaaacaaaaaagaactgtccttggtatcataattagtgctcagtaaatgatgattagtaggattattcattgactacttaatgtgaaaaaggtcagaaagccatatatatagtgtaagacctgtacatatgtatgtgatgataagaattatagaaatttactgtagatatttacatccatatacaaacacatatatatacatacatatacacacatataccttagacatcaattttattatctataggtaatgagttcagggtaatgtttattttttgtaacattttgacatattccagatactctacagtgaagtttttattataaaattattatctacatctattattatgactattattactatcattatttttaaaaacatcaaaaagacagagagtttcacacaaggcaacttagttatccattcactagacattagttagcttgttaaatgctctcatcagctttatgagacagctaacatcttattcctcattttatggtgggtgaaaatgtggctgacggggggtcagcattgtgtccaaagtcctaagtggagtgaaggcatggtattcatgacctgaacctccatgcagtgtgccctttcagccacagatggacatttgttcttgagagsaagattcagttagcaaacccagggtaccgtatcaacagcatggggactggcataggcttcccagtgctgaagtcccgaagttctttctgctttgggacaagatacagacagaagaacaagatgagctggccactcctggagaccagatgaagtggccacagatatcaagaggggaggcactggggggaaagaagccaagtgggactgactctagacattagctaattgaggcagatcttttgtgatagatgaaaaccctttggtacctctccccagattttgatagctgctaagtctccaagtaatgtaccttgggatagatttcgacttcagctttttttttatttttattttttgaggcggagtcttactctgtcgcccaggctggagtgcagtggtgtgatctcagctcactgcaacttctgcctcccaggttcaagcgatttgcctgcctcagcctcctgagtagctgggattacaggcgtgcaccaccatgcccagctaatttttgtatttttggtggagacagggtttcaccatgttggtcagggtggtctcgaattcctgacctcgtgatccgcccaccttggcctcccaaagtgcagggattacaggagagagccactgtgcccagcctcaacttcagctttaaagttcaaatacattcctgtctccctactaggttccatcacctacccattttttcaaacttatttttatcaacaaatgtgaaaatggttccattttaagttataaaagaaaaatacacttttttgttgggggaaagcaagtaaagtagatgtttatacaggaaaaaacctactgtttttcagtgtcattcatcttgagaaatgctttttgtgcccttgctcattgaattctcacaasttcatggtttggagtttatttaaatgcccccaatttatgcacgagggaactgagtcttcaagttgtctcattttttggtcatgtctgattagtattctgttctatgtctgtgccttaaagtacacagccatttccctatgaatgaacagatgtgctatttctaatattttcaccattataaattatgcttcaagaaacatctttgtatgtctattttacccctgtttacccaagagtatctatcttttgaatccataaattccttattgttagatcaaagagaatgcatattttatatcctgaatttttttcctgcttccagttttctaacactcacacatacatgagcacacgcaagcatacacacacacaccacacacacastatttccaattcccatgtactaacatttatcatggggcaggcattgctcttagtgccccacacccctgcaccttggctgtgttttgagatgagcwatcgcgttatcatcactgtcttcacttcacagatggggtaactgaggcactgggggcagaaaatcacttgtccatttgactccagattctgtgtgcactaatctagtcacgtggccatacttcttcccttagccatcatgcccttctcctgcatgtaacctatttggtggcttttccaaagttttcaagatgaagtacaaagttcatggcaacaaagaaaaaagtgtccaattatctggcccttttcrgtctgaggactttttccttgcaatagggagccatagaatgtttggtattcaggagttacatggtgggatctgggtttgagagagatttactcggttattcactatactgtgtttgttaagagacattgggctcttccacttctccaaatgtgttaaagacttccctaaggtgctggaaaggagattggcaaaaattactaaggggatttaaggcagcttctgyatagaacctccctcacaccctgcmccttccctaagctggattctcaaagccatgtatatagctgtccagcacctgcccaaatgtatttaatgtttgtttgataagaagaaaccagtatatgctgcaggattcccagtagcaagtttattttaagattggaagagccctgtactcctctgtctggggcccagctgcaggctccctgaccaggtggacacctytgggaagtggtgtttttggaaattaagccaaaacagtgcattgccctgtccctagggcagttgaataaaactgttggagggagaaatgcaagcgttctccctcagaaccaggtcttaggtcacaccctggaaaagagagattaggatcaaaggtccttagatctaaagacacctgagagattgtgttccaagctcccttagcctcagactcaactcccatttatcaaccacctgcaggattttatatccatacaatgtctcatttatgcttgaaaagaagttctcatattgatcagaagcatggccttgaagtcaggactgcctgggttcaaaycccagatgtatccctagctttgtgattttgaaataattatttaccctctgtcagctttaatatcctcttctgtacgataaggaaaatagtagtgcgtactccaaaactccagagaaggaaaggggtttaccgtgtctaaagcacagtgcaccaatggcagcatggagtgggagatgttactactcatattttcagcatgcacactaccctggtttgttcccaggtctgcctgactccctggcctgtgctctctgcctaaggcaccatgcctctgtagtcatgcagcactttctcctgcaatccctctcctttcttttccaatcttagccgtgcaatctgatcagcctcaactatctccttctttagaagccttcctggtcgcctgcctgtccctgcwcccacccatgccgtcttcctcsctttatcagtgattgacatcacagactttagtagccttgtaacaaccttgactcatacactggactggtcttgactccataactagacttgtacctcatcatgggcaggaacttttaaagtttcatctttccatgcccttgggcacagagcagaaatgtagtagacactcagaaggtttgtttgaagggtaatatcagcacattggttaatagtgaaattaatgaatgagtggatgaaagaatgtgaaggaatgagttggaaccagtgagtgcatcaatgaatgagtgaatggataaacaagtgaatgaatgaatgaatgaatgagagatattgagtggggggtgagggagggagggagtaatggaattgttgacttagtgcccagtggatktgggggccatgggaaataggggaaatagctcatcttgcctgtgtcctttgccgtgacctctgggctgctctcttcccagtctcagccatactttttcagttacatccacccttccctccctcctgtttcctctcacctgtctccagaagtgatgactacactaatttgttcacaggccattaactcttgagagctggaagaggccagccctgagttggcaaggaacgacttgggtgctgactcttgggccgccaggagccgtcattactctctcatatgcctgcctgccttgcggcttggtgcttatctctccctctgcctgcttgcaratgacgactgtacggactccttcacgcccaatcaagtcgccaraatgcactgttacctggacctggtctaccagggctggcagccctccaggaaaccagcgcctgttgccctcsccccccaagttctgggccacacarcggactctgtgacactggagtggttcccacctatagatggccatttctttgaaaggtgagtgtgccctgtgtagtgttgatccctctctctckctcctgccaagaagaaggaaacttggaagggaagcagacttggagagggattttactgcatttcttgttcttgttcaaaaggtatctccaccacctagcatgttgtaaatttgggatcagggaataaataaatggtcattaatagaaacaaataaataacaataaatatttttaagtgaatgggtacttrrattcactttgttattagaaacttggaaacctcttttgctacagacctcttctgggatggaggtaatagtctcatctccatgagctcaggagttgtgattgcctgggcaaaaacatttatattatattatatattatattatattaattatattgtatcatattatatatgcttatatatggatatatatatttatgtgtgtcacatgtgtgtatataagtacatatttacatataagaatacatatacaaggccgggcatggtggctcactcctgtaattccagcactttgggaggccaaggtgggcagatcatgaggtcaggagttcgagaccagcctgaccaacacagtgaaatcccatctctactaaagcacaaaaattagccgggtgtggtggtgcgcgcctgtaatcccagctacatgggaggctgaggcaggagaatgcttgagcccaggaggcggaggttgcagtgagccgagatggcaccaccgcatctcagcctgggcaacagagcgaaactctgtctcaaaaaaaaaagaaaaaagaatgcatatacatatatgacatataaacataatttttgcrccaaatgttttttttttttattttgtagaactaaaggtagcatttttataagaccagggaatgataaactgaggcacaaggtacctctattctgctgccctgacwgttcrttaattaaccacatggccttgagcaagtcactttctgtctctgagcctgattctcccttccctgaaaactgggtctaatgatactacagtggcttgaaggtggagacctgaatcaagtggtctcttgtgatctttcccccatataaactccttgaggagctcaagctctaaggggaccagatttaaaagggtcatgaaaatagaccaaggtatttgcatctattttggaattttgccataattcagggaagattaatgtattacctctactcccagcccttctttgggatgcttcatctagtaatggtgatatattaatgatggtaaaaataataaccatgctaataattagttaatattactttattgtagttgctgggatctatcaagtgcttactatgtgatggattctatactaaatgctttacatacagaatctcatttaatctttctggtaaccttgtacaaaacaaatcatcttcctcatctgctagataaaaagagaattggagctgaaagaggctgaaaggtgaccagagggtcatggaaagtggcaggcactgggcttcagctcttgttttgtattgtgttatctcagactcgtatgtgctttcattaagttgtttcagaactagaattggagaaaaggcattacactgccccccgcaaggmaaaaaaaaagccacaaaaagaagcaagaaattctcatttacaagtgtatttgtctgcatttgtgtgtgtgtcaaagacatattaggcaaaggacctaaatagacacttcaagacacacaaatggccaacagctatgtagaagaaatgctcaacctcactaatcatcaggaaaaggcaaattaaaaccacaagaaggtgtcaccacacacctgttagaatggctattaccaaaaggaggaaagataagaagtgttagccagggtgtggagaaaagggaacacctgtgcactggcagtgggaatgtaggttaatatagccatcatggaaaatagtatgggggttcctcagaacattcaaaatagaactgccatataatccagcaatcccaattctgtgtatatatttaaagaaattgaaattagtatgccaaagagattgctacactcccatgttcactgtacattattcacaatagctaaaatatagaagcaacctaggagtccatcatcagatgaacaggtaaagaaaatgtggtgtacagatggtctccaatttacgataatttgacttccacttttttgtcttcacaatgacaaaaaagtaatatgtattcagcattgctttgagtattaagatggtataaacctattgtaagttgaaaatatcgtaagtcaaaagtgcattttcaacttaccgtattttcaacttaagataggtttattgggtgagtcctaaccccattgtaagtcaaggagcatctgtatagacacaatggaatactattcagccttaaaagcgggaaaattctgtcattttcaacaaaatgaatgaacctggaagacattatgctaagtgaaataagctagacacagaaagacaaataactgcatgatctcacgtatatgtggaatctaaaaaaaatgaattcatagaggtagaaagtagaatgatgaccaccagaggcaggtggggtgagtggggaaagggacgatgttgatcaaagggcataaagtttcaggtagatgggaggaataagctttagtgatctgttgcacagaatggtgactctaataaatgataatgcattgtatatttcaaacttgtgaaaaggatagatttcaaatgtttttgccaaaaaacagtgtgagagatgatggatttgttaatttacccaatttaatccctccacattgtaaacatatatcaaaacatcttactgtactccatgaatatatacacaatcattatatgtcaattaaaaataaaatgttaaaaatttttgaaacctatttgatcacagtaccacataaaatgtgggcattaatttttcacattaccatcagtacctgagtctagaacctaaatttggtagctggcgaatgtgatcatcagggaaggaaatgcacttactatgctctgtrgaaattccccttcccctgccccagccatcctcactgggagcacagagctgggtttgggaaacctcgtgtgacacttcagaggtttccagcaggccatagatttatttactttttctgtggtgatgagaagtatcagacttttggtcaagccttggcctccattccacttgaaaatggaagtttcataaatgaagcttcctgtgtatgtatttaatttatatttcataaagcagttactgtccattaaataaataccacctgattgttggaaacctatttgagggttaattgttgtgtaatgagatatgtctctattacacagtgtccttagcttcaatcaatatgtttttaatcacctatagtcagttggttcttgaggctcatatagtagctattctgttcagtttaagatttcataacatagttatcatacgttaaattaaaactgacatttccaaaacatatctaattagggttagcagctacrttgaccatagtctatggctaaaagaagtcagtccacaaattcaataaattgttgtaaagaaatggaactgtctttaacgtatatcactctcccatacagatggaatttatactcatgcaaattggcttagtagaaagtatacaagctttaatgccaggtcatacatttcccgtcctcagctttatcactcccagtcaatgggaccttgagcaaagccatctcacctctgatcctctgggccttcttccatcaaaatgtgctcatcctgcccacgtcacctggcttttgtgaagaatttagcaagataacggtgaaatgccaagcacacacactctatgttcaagaaacatcagctcccattttgtgcaacattttccagagctgtttagcttcttaaaaattccctttccctgcaaagcctctggtgttttccactacatccatcaatgccaacctctcgcccctggccatcctcatgtcctcctgctgttctcacatctgtggtctaagagaatacaagggtttcccttaaaaaaacatattcagatcctcccacagcctgtgtcctcacacatgggcaactgaataaataattcaaggccacccctggttttcctaactcctttatttttatctgtcttgcaaacacgtgttgactgggttgtttcagttatctgacaattggccatggtatattggaaatagtactggactgaaaaccaagaaacctgggtctgaagtctttgygacctcatccattccctctgcctttggcctcagttttctgatgtgtaagccaaagatgttctaggctttctcaaccaaggttcytcttctaaattttaagacatggaaaatgatttgtgtaactatttcctcatttctcccaaagatggtatataataagtactattttagtttcataggagacaagttaattcattatatacaatggatgccttggagaaacactgtccaataggatttgctgcaataacggaaatattctatatcagtactaasattatagccattagccaactggggcttgaaatgtgactggtgtgactgaagaatcaaatttcaaattttatttatttttaattaaattaagtttaaatagccacatatggctaataggtgccatattggacagcacatacttagagctttaagctttaattttcatgaaacccaagtaagaaagatgagctctcccagctttggtatcctgcatgtctatgatttcattgtgtatgtttgtgtgtgtttatgtgtagatataggtatccatgaagacaatgtgaatgtgaaaggtaggaaacacatacaattcctagatgtgtaggacaggacatcatacatttgcttcagctggatgattatttgttcactcatccaagtatttattgggagcctgggatgtatcaagaattcactgaaactcaggtggctttatgtgtatcacccacaatgaaacatctaaagcacatagacgaaataatgaatgaccatcaaggtcagcatggttcctgaattcatcccagaacatttgtaaccccagtgtcagtctaaagccagtcatgtgactcaaagccactatgcgtggattgtggtcatcctaagggaatgcctccattagcagtgctgaggaagcctttctctccactcctacttttctgcatttgagtatatttgtataattgttattattgctactccaagagtaactcatgtatttaaaatatgtagaaaatttagaaaaccagaaagagtaataatagggggtgggatcaatcatcctatattccattgcccagaaattgctgctgataatattttgtttcatagtgttatttgaacattgagatattgctatagatttagctttggatrttactttttcatttaatattatagcttacacattttccatgaagttgcataatatttataaatatttctgcaataactgcttgscattccattaagcatattaaccatgggctatttaatgattctcttatcactgaatattaatattagtgtgcttgcaaaatttccacctacatatggtttcatatttacaatgataaggctgagaatgcaaaacctacaatttgaaggtctgcactaagttagccatgagtattagcacatgcctaagtgactggtatccatccatccatccatccatccatccatccatccatccatctatccatccatgcatacayccatccattcaactgcttatactgaccaacattataarataagttgtgtgctgtgctgtgtgaaataaaaagatggttattagatattractttgtcctcaaggacctcacaatctattaggataaactctcctgcatgtcaaaaaaagttttcacagaggaaatgatgtcaaaggtgaacttgaaggaggagaaacatcagccaagtgaaaaaagtctgcagaggggatgtgggtaacatgacgcaacatgataggtagacagagcttatcatggagagaaacaaagctagagtgaagcagaggatagtatgaaagagcattgaataccacattatakggcattaggggataaaatcactgaaagaggtaagcagaggcatgacttgttcatcttgaggtttggggatgatctactgtccgctgtgtggaggaggaacggggagaaacagcacactctgatgctcacaagcacacggttcctgactgtgtgagcccagaggcatagtgaacgtccctgtgaggggaaagccataaggaaggcttcagacctggcttctccattgcatcctttcaggtagccaaagcacagaagttcttccaggaatgatgaaagagttatcatcaggaccattgcactttgagaaataatgggttgtgctgggacatttctcgacgtcttcccgagattttgtttccagtccctctgcagaggtcactcagatttgcagttttcagttcacaataagacaggagaagaggactcrttcctctcccttctccacaactgcctcataaacagatgccaaatctggaaaatgagtaggatcccagagactctatagccaaaggaagattgaatccagatacacaagacccaacttggtaggggaagccatcataatattccacttctgggactggtcccattgagggattggctagccccttggaaagccgctamaatgaattagatggcatggtagagaaactgcttttgactgtaaaatcgaggagtgactcatccatccacagaatgtcaaggctggatggttctttaggcatcatttaatccagccctcttattttcagaagaaggaaccatgccatcttcatatttaatgcctaaaacacaagatggtgtytggcacatagtaggtacctgataaatattgtaaaaggagtaaactttgagaacgaaatggagcaagagattttctcataactacattgcaaatcctcagtggagctttatatgcctgataaaattaaaattattgcaggtggtgagacttcagcctgttgactttgtgctgctaaaagtcagagaaatgtatgcatcatcagaacagaagccacttaggctcaaacgaggttcttgctgggcaatggggaggcatttcacttayggttatttccagaagccttggcatatgtaggcaggaaagggggaaacacagatttgttgtgtcctctgccccattgactctggcctagtcccatcagttgctcattcaactgttcctaagtcggtgcattttccctctttccttggcctcctagagaattgggatcagcatgtcatctttgcctggargggagaatcctggtgcagtatgcttccaacgcttcctccccaatgccctgcagcccatcaggacactggagccctcgtgaagcagaaggtaagccagccttctggaagctcattgacaggaggagtgtgcaaagaacagctctttcmatgtatatggggttttattatttttatgggtctttsccatgtatcatttcatttgagtaacatcatcctgcaaggttagtagtcaagcgctcatccatttgacaaatactttttgagcacttgcactatcctaacatgttgttctcatattacaaatgaggaaacaaagacaataagatattaaagaagtgcccaaggccacacacctgatacaaacacagtgtcttgggggtatttatatatccttcagaccccaactgcttgtagttacaaacaaggccactttagagtcaatacaaatattttggggcttcaaggcatcagtggtctttgattcttcttctgttatttcttagactatacagagcactttcacatgtgttgcaactattccttttaatttcttctatataccctctttttgggatctatttacctgtaagacacataaaggaagtgccttatgattgccactattatgggttccacccactatcagactcttccctgctcagggttgtctctcaggcttaccaaggaaccaatgatctctgtgctttcttacatcatcattgaaattaagagaagaataccttttgccaaatgcttgttgtcacactttgtcacttggcctcagaaccaggctggcagaggctccatactttcctcttagtctttcatctccccctccctggtactcagggatgtacacatagaccctgcccccacccagtccctcttgctcttctgcaggttagctcatgccagcagtcactgggtgaggacactattacaccagtgcatcaragggagcggaatcagtcttctcactgaacaccagtgaraactcctccgctatcctctatwtttttagaaagaaggttgaaaagaaaaagccagagatagaataaagcaagggggaaggatcagagaggaaagtgaagttgaaaaacgacggcactgcactttattttttaaagtagcttaaaataaaaatgagagtcaaacttgggaagtctaaacaaatccatctggaatgtaaagcaagagggatgtctgggaaaagccctcagttcagcctcacagaatcacaggctgtcagacctgagagggatgcctggggtcatctggcccgggctccccccaagtgcaggaatcccctctatgtgcatcctcactgaggttccctggagcctgttcaagctccagtttttyagraagttctcraaatctgcaattgtaatttttccacccaaactgaacccactttgggttgtcacagaraatgtgtgtctctgccacctgacaacattttgcatgcttgtatctagtgagcctgtctcactagtgaccaacacaggcactatatgctgggcactgtcttgggcacatgggcaaggcagtgctgagtgtctgctagggaagtcagataagtaaatggccaattaccattcaatgtgaacaggcttatggtaatagaagtaccaagtggtgctgggggcccataagaaggggaccccatgcagaactggagactcagtcttcccatgaaatatcacaacactattaacgaggtgcatctgagaatgtgaaaaagtttggtatgttcacagagtggctgttttctaaatctacttcagaggcttatagggttcctggagacgtttatagggtatcctcaaagtcaaaagtattttcatacaattacatatgacatcatttgctttttccactctcattctctcctgagagtccagtggagctatctgatagacacatgacatgtgatgtcatttgtgctctgatagctaatggarcacactcttctgtattcttgaatttttaaatttcttagctttagtttataaagcrgaaactactaatagatataacctgcataagcaaaagttcagtaaggctataagagtttaagtaggttcagaacatgtaaaacaaggtagaggtggcagaggtaagacagatgagatagataatggccaggtgaggacgggtttggattcacagcaagggcagtgagaaaaccatgtgctttatgagggcatgatatatggtaagacctgcatgtcataaagattgctcagactgctgtgtgaagaagagatcaagaggatttggttgctagaggaagggaagcagcaaggtgactgttgccaaaatccagctgaggaatgatggtgggctggtgaggtcggtggctgtgagaatggagagaagtttatggggttgagaggtacttggaaggtagaattagcaagattctcccctgagatgtctctggctaaaattatcttgctttgttctaccacttgtttgaataaaattatttccagacatctccccacacttacatccaatgcaactattagttggtgaagtttgctcctagtttgttcctgaccttcttaaagcatgatatgcagaatggagttcaactggaggcactgaggtctctggttccctgagccaattyggagctccaaggaaacccagcagccttgggttttcctcctatgtaaatttagtacatgtgcaccaggaaaagacactgttctttttttagagcatcctattacagtctctgtgatccttttggctcagacccttttaatatccttgaagaaataaacttttccatgagccaaactctgcaatttatttctcaactcattctcatcctatttatcttcacatgtttaagtttttggacttcccaaactaacttaaaactcccaaattcatgagcaatgccagacatatctgtatggttggggaaaaaacatggggaatgcaggggagggaaaggaggaggattggaccatggtctcagccctactattgatgtactytgtgcccttgagtgagtcacatagcttctctgaaaatggcattgtatccacagaatgaaaagttgaaatataatatcctttctagctytaatattgcatggagctgtaacttcttttcatataatcccatattaactagcagaagattcttcatttaacaaatctttattggaaatctactgcatttcattagcttcatttctaagaaggtaaatacagtcatagractgcttgcctttgttcatagacagtggttgcactcctaccccttgagcaaaaactgtatttcatacatgaatatttttgagatatttgaygccatgttttatctgtagcctataaattagataaatatatatttcttgatctgactgactcaaatcccagttaagatcacttatgcaagyataaaatagatcccaagtgttgggttttccatgagagattagcacatggcactaactgtttttattttttctcatttgtgtgttttctctatttttctgcccagaatatttcaggtgtgcttaactattcacctggaaaaaagcttggcaccaagtttttataactatatttgtgtcaacagctgcagtgtatatatatatatatatagatatataacgggtgcctgtatagtgcttcacaaaagtaaatatagatcagcatgattatgtataaatatatgtctatacacatatatgaccttatttctagtggacagtttatataaacatgtaatttttaatttaatcactgtatatacaaaaggatatctattaataatgaagtaacagggcttttacacttagttctcttttcttctttgtttattcttttctccccttccacctttcctcctcccccttccttatcttcttccttcccttctcgctttgtttcttttcttcagctcctgtccttaccttccractacatgtccaatcaatctcccagctgtgttcacttttcctccttaggaattctgacttgccatctccttgcatgctttcttgcagttcatatattgtctgcgttagtccaatactctcctaactagtcttgcaagactaaaagctccctgagaacagagatcatgttggcaagcttattctcttggagcctagcctacctctggacacacctggcactgaatagttactctttgaatgcatggaatgaatgggyggatggatggatggatggatggatggatggatggatggatggatagtgtctgtgtctctaaacagtggtttttcttttcttttctttttctttttttttttttttttttttttgagakggagtttcactattgttgcccaggctggagtgcagtggcgtaatctcggctcactgcaacctcagcctcacgggttcaagtaactctcctgcctcagcctcctgagcagctggggttacaggcacgtgccaccacaccgaggtaattttgtatttttaatagagatgaccatgtaggtcaggctggtctcgaactcctgacctcaagtgatctgcctgcctaggcctcccaaagtgctgggattacaggcatgagccaccgcacctggccaacagtggtttttctaaaaggcgaccctgatgtcactcatttgcttaaaatttctcagtagctcttcgtctatttcagtgtaaagttcagtttcctccttaatgtagtatacaagccacttcacaatcttggttctacttagcttaccagcctcagcatttgttgctctacaattgcacttgaaaaccatagtaaccttaacttacactctctcccaactattctcatgcttggaatacctcctcttaccaatattttccttgttaatacgtccctactttccaggacagagctaatatatttatgggaatctattaatgatctcatcctatttgaggtttacagcaaccttgaggtaggtaacattacagtaggtaacacaatgagaaaccctataactgatattttaacccaactttcattccttcaaagcctggcacgctgcctggaccaacaatatcatattctactccctgccagggaatttctgaaccatctgagtctcagtttcctcttctgtaaaatgaatttcataagacctgcgtcacagacttagtgccaacgtaaaaagacctgaggcgtgtaatgtgcttggcacagtgcctgcacattgaggatggtcaactcgtgaaggctggcattattaatgaggttgctgctttggttatggttacacttggtgcctctagggactcttttttacatctaagggtttgtctctaataaccagacaaccacaagctttgctaagatttctactcctgtttacttgcttgagcataatgaccagactcaccttcctgtcctttggaagtatttggtccctctgttgattaacaagaaactagggaggaaggatgagccaggcagatttgtcatctttgctctcctgtggcttcccacccctgacagtcattttctccaaggaagggaggaagattacatcatcccttgccagttgcaggagaaagcccatggaggggtggaatgttcacctggcacccaccatcaggaagcatgctttaatgttctatgctgtaacttttaactcaatgttaacaggctagaaggttaacaaatatttatttagcatctgctatgtgaatactctatggactaggcmcmctgtattaagcaaaagctacatggcgttgagcgaagcagtgctctttaatagagacaaaatgacaacgatcttacaggattttgatgacaatcagatgagttaactaataactaggagatgtgtttcatatactgtaaagtgctgccttcaatgaagttgactgaatgaataagtgatacatgtgtgtcaacatcccacaaagttaagaaagtcaggaactcagtgtgtgggaaagtagacaagaagaaaggcttcagctaggtggggagtcctacttgtgttttacaccctaaactaaaggttgctttgagccagcagttactgcaaataatgaatgaaactagccaaggagagatagaggaaatcttgtaattaaatccatcttttcttgctgtgatgcattatatctaagaagcctctgtgtattttctcacccctccttctcttttcctcttctcttctccatctccacttggtggcttctttctttccttggctaagcagaggcaaggaggttagaggcatttacagccttcactggcatagttttttcactccaaataactttctagtattgacattatagtgattcctgttaccctgtaacattaccacaaagcgtttttaagcaaagatcttttttttttcttatttgcttcagaaatgtctagggtcaccaccaccctcccaaccaaccactgaggctgaagaaaaaaaaagaatgtggctaggtgggcatggggacacatgcctatattcagctactcaggaggctgaggcaggggaatttgagcctgcaatgagctacaatcagaccattccactgcagcctaggcaacagagcaggactctgtctcttaatttttttttaaggtgtctagttgggcaacttgaggtccttcatcttaccatccggtctgtctctctcatgaggctcccttaaacaaattagagccaatcactacattgagtcctggttattttcctcagtagtgcaaggaagagctctctgggagtctagatgtgatctcagcagagaaaaattcagaagtcgctgcaggctgagatcagtggggatgaggcatcatctccctagggaaagaggagaaraaaccctccttccttctccccgctcctcacccaaccctccccttcctgagtgagacagaacagagtgcggagaagctcagtggtatggaatgactgcatgtagagaaggggaggaggagagataagagggctccaaggctgccttccagctctgttgttcatggttctagacagtttcctcccaggtcctcagtctgcagggtggatgctatttatgctcacctattctttgctggtcggggggtggggttaggatttctgtcagtccaagtaggttttaccaatggcagtaataccacaaggattctaatttattctactgtcccctgcatccaatagggagaacagcaaagaatacagattccaaaatgaaacaaaactyggttccaatgctggcttttacacttcaagttgtatgaacctgatcgattcactctatatttgggagccttagttttatcacctcctaaataagtccttgcaagaattaaagttcaggggacacagtgggtgtttagccaatatgtaccctttacttcttttcatcttaggcagcacagcctcctaagtggaagatgaggaaggaaagtttgaacattgactcggtagtgagatgaaagcagtttgactgaatgtctggtgattcctctgaaatctgtattgcaggggtggggatgagatggatgctgtgtgtatagcagattcaccaaggcaccaagaaccttcctctccttttcccctctgtctaagttctagtcagaccaatttctcctggggtccacaggaaactctaaggatgggaataaagctctttccccaagaactcattccctcatctcttctgcataggtcatcctgatgttgaacagccctgtaagtccagtgtccgcacctggagcccaaattcagctgtcaacccacacacggttcctccagcctgccctgagcctcaaggctgctacctcgagctggagttcctctaccccttggtccctgagtctctgaccatttgggtgaccyttgtctccactgactgggactctagtggagctgtcaatgacatcaaactgttggctgtcagtgggaagaacatctccctgggtcctcagaatgtcttctgtgatgtcccactgaccatcagactctgggacgtgggcgaggaggtgtatggcatccaaatctacacgctggatgagcacctggagatcgatgctgccatgttgacctccactgcagacaccccactctgtctacagtgtaagcccctgaagtataaggtggtccgggaccctcctctccagatggatgtggcctccatcctacatctcaataggaaattcgtagacatgtaagtgcattctctgaatagggagtttattaagtgggtgggttgtggaggaacgtgaggtgggtcagagaggcctggacagggggaaggttcatcacagtcaagactcactctatggattgtaacccatcattgggtgtagatttgtcttaacatggcagagttgatatcatgggaagagcaatagggaaggaaccattagacctggatttagtgacaaatctgatgtgtgaccttaagcctcataagcctttcttaatcttagtcattccaatagtaaatgaaggaggttggatgagagtagcagtgagaaaatcatttattactaatgaaagtagaagaactgaagtttgctaatgattttctttttatattaaattgaagacaatttatgcattttgattgctttttcagtgggtgaatcgggggtgaagttatagtagattgggtgggggttgggcacagtcctaggtatttgcacaaaaattgtgctggaaagtgaatatcaactttaacagcacttgtttttgtcttatttcctgaggcagaacagtggttcaaacccatttgatccttagggcctttgcagctttaggtttcygtaactctttctggatgctcactgctcttatgtgaagtagtacttgtctttcatactcacttcccggccagggaggtggctcactcctgtaatctcagcactttgggaggccgaggcaggcgggtcacctgaggtcaggagtttaagaccagcctggctaacatggtgaaaccccgtctctactaataatacaaaaaaattagctgggtgtggtgatgaacacctgtaatcccagctactcaggaggctgaggcaggagaatctcttgaatccaggaggcggggttgcagtgaaccgagatcatgccattgcactccagcctcggccacaagagtgaaactccatctcaaaaaaaaaaaaaaaaaaaattactcacttctcaagccacctctctattacttcttccccaaacatcctcagaatttctgtcttaggaggaagaccatcttataatgaagccattagtgcttttcctgtgtactagaaaatgggctaaggtctttcatcttttactcattccatcctctccacaaccatagccctattattcttattttacaaagaagaaaactggggcttagagatgtgaagtcacttgtccaagatcacacagttaggaagcggtgaaggtaaggattggaatttcgttctgactcctaagccactgcactcaactggtgctcaattaaagatgtgattccaacttctgttttaatctacaaaaaggatagagtcttcgccatctaacttgggtgtcaatggtttctataggccttttgtggctctttatttggttctaaaatgatgtaagacaatctctgctctgtctacttgaaaatattcactaagccaatcattaatgggaaccaagttctagaggaaacttttaatctttttaaagggcagaaccactttcaaacactttaccagcacttccttttacatactagcaattaatgtgcacatcacaggcaaactcttgctaattcattgaatcagagatgaggaacagctgtttaagaactcagaaagagcacttggtttgtgtttgagaatgtacttaaaatttaaaggatagtcttgccttaaaaatattccataaccctgtctcttccatctcctcacttgtctagagtggtagagttctataaatatgcttccacttaaactttctttataaaacaatggagggaagaaataatagatgttttaaaatctcagtttaaactcagctttcctttttttgcctcgagttacgagcctatgagagctgccatgggttgataagtttgaaatggtgaaaattaaactgaataaatgaaagaacccttagtgatttagcttagttctattctcagcaaaatctcagctaaatcactaactggctctaccctcttaggtgagtcacttgtcctttctagtcttccgatgcctcaactttgcatgcaggaggttgcactggattaattcttctctctctctttttttttttttctttccaagacagtcttgcactcttgcccaggttggagtgcagtggtgtgatcttggctcgctgcaacctccaccccccaggtataagcaattctcctgcctcagcctcctgagtagctgggattacaggcacgcaccaccacgctgggctaatttttgtgtttttagtagagacggggtttcgccaggttggccaggctggtctgagaactcctgacctcatgatctgcctacctcagcctcccaaagtgctgggattacaggcatgagccactgcacctggctagttcttctcaatttggattgcacatttaaaaactgggacatttaaaaattgcctgggtctcacttgtatcccatctccactctcccccgagatatttatttaatggttaagaataaggcctgaccattagaacttttaaaatctcataaggtgattataatttgcaacaagtttaaacaagtttaaaaaccagtgcacttaaacaagttctcaaagtgtggccccagaccaatggcatcagtatcacctgggaactgagaaaggccaggctctcaggccccagtccagcctagtgaatcagaaactctgagtgcagggcctctccaggtaatttggatgctagttaaagtttaatagccactgctctaaattatctccaaggccaggaatctccaaattctctttcactcatgcaactacttgctcaactcacaaatatgtaatgagaacattctatatgccagattctgtactggaaacagtattaggatgactcagaccagtccctttcttgaaggcactcaaacttaagtgctgagctcctacccactttgtaaaagtgccacgtactgtgccaaatcatcagtagtgaggtcgacactcttatgcacaatttgttctttcattcactctccaaatatttctttagtccctactatgtgtcargcacaagggctagactgaggctttcatcggccttcctcttcgaatcttttgtgtttcaaggagtttattggagatctgggctgggatgggctgggcttcctgacctgaatgttctctgagactraaaaaagagaaacacatccttccaaatcaacctaccatttcaactcctttatctcttggtaatttgagtcctgaaccccaccacaaatacctctttgtgtgtatatgtgtgtgtatgtgtattttgctgctttcacattttttccatatcaaataaattggctcttatacaagttctatataaagactgttttggagaaaaagaggagagggaaaaaatgctttctttttctttcctgactcaacccattacatgattccctttgacctttgtcttcattttttttctctcaacaaaaatatttattctttctgtyatctacactggagatagtttcccaaggtatgacagtgatgaagagagagccttctgtgcttaccccatggaaacttctagtagactgattacttttggccaggaccagaaagaaatgtggaacatctccatctcccttaagtggaaacccctctatcgaatgagaaatgacactatcagaagaaagggtaccagtgccaactctgctacaaactcaccatatgacacaaagacacaccgcatcacctatttggacctcagtttccatatctgtacaatgagaggccaacacattaagcccttctctatgggtagacatagagaaggtgtctggggtaacaggtgattcacatacttttttgtagtaaaaggaattcaatagggattatctgtaagaatcagtacccagaggaaacctcactggctctgtatgccctactgaaatgtggaccacaataatgacaaccatttactaagtatttcctctgctttaagtgccttacaaacacttctgaggtaggtgaaaaagcttaaattcagagagtaattaaactaacctcatacagctagtaatgacatagacaggcctcaaacttaagtctaattccaaattccaccttcctaaccactacccatactacttcctactacaataatgtaaaggcagaattttagagctgagaaatgcatccaatctggccaaagctctaaatatagcaaggggaagacaggcttacaagtcagaggccactagtccacaatcagtccctgtggcccacccttgatgtcttggtgtccaataacacaaattacacagacagttctttatgcttctggctgggaagaaatagcagggaagcatctttttctccacttggctgtcaagtgcttctacactgagcactgtgctccttggcctatatggaatcttcagatttctccaagaagtaaatactctggacaaaactgagaaagcaaagtataaagcaaaccaggaacagtgaacagtagctcactctcatctacttattggtctgtctcattcatccatcacttcatgcaacaaatattcactgggtatctattaggtgctatgcactattttaagaaatggtgatccagtggtgctgaaaactcaaggtgctcacagtctatgggaaaagagagggacaggcaagcagtgtcattgcagtataataatattctgatggaagaaacagaaacacagagtcagaggtttctaacccaaacttggatgaattgaagtctaaacttagaactagaatataaactccccgagggctagatttttttcctgtttttctcctggtgcattccaagcacgtagaacaattatagacacaaggtaagcactgagaaaatgttctttaaatggttctggaatgaagaatgagaaggaatttagcatttgaagagaaatggagaagccaaaatgtagtaagcttgtactatgtgtcaagcactaactagggactttacatagataatctcatttgatctaatcatcccaacaaccccacaatgtaggtggtcctatccccagattatatatagggactggaaactcagagaaggaatgtggattatagtttacagctatcaaggggcaaagctggggtctgtaagtagatctgtcaactccaaagctaatgctcttgatcattcattctctgattgaacaagtatgtttgtttatgcctctgtcttcttaggatcctcagttgagagctagaaatattcttaaaagtcatctctctcaactggcttatttgtgtatcccaatttagtcatctattaattcttctctcacattcagacctgtaaagcttccaacacaatctatatctattttatctcacctccttggcattctcaatataattctttggggaaatgaatagacataaggaaaggagatgtttatatgatctgggtggacattcttgtgagtccaaattttacaaatcagatccaaatttttgcctctgaactccaaatgctttgaatacccatcaattagaaactttagtgcattcattaattcacttgctcagcaagtatttgttgacttccaacatgagcttaactactttctaacctctagggattcaataatgaatacagcaagaaaaactttttgtttcattgattattatcctgtagttgggagagataaaagaagcatgttattatataatatcccagttggaaaagatttagtgatttttagataggtggtcaggaaagtcctctctgatgagatgacatttgaacagaaaccagaagtgtcccccagtaacttataatgaaagctagctgagctgccatccctgggatcccagcctgtttggaatatgaatttcttataacatgatccttagtccttgatcacagtttgtgttgtattatatttaacagtgcttgtggtttttccttcacctggttcatattcttaagtacaaaatttatgacacttaaatgacacaataggggctccatggatacttgttgatcatgtgaagaataagtcagcagtagcacaaagtgggctctaagaagatgcgtctcttgctttcagatcttagttataacattgatatgtaatgtcatattaagcctcagaggatttggaaagtttaccccaaatcagggtcaggtgaaggcacaggtggctcttacatgctgtttctatggctcttgagctgagtcaccactttctttcttcctttttttttcctaagcctcatttctttttatagctctttccgtttctcaccttgtcatccatcctttgttcttgtatgtattaatttattcattcattcatccatcaactagtgaaaatctaatataatccatgttaagtaatacttgtcccatttaacaaatatttattaaatatctattctgtgctacgaatgcagccctgattaatacagacatgatctctggcctcatgagcacatggttctaaatgaaaaatattatactgcagcatgaaaagtgttatggtgtgaggagcacggggggcaggggggctgtgagaaaacatgggaagggtgtctaactgagcttgaataggtaaggagggcttcttggaagaagtgacatgtaagctgagacttgaaggatgcataacagctgatcattgaagaagttcaccacagttcaaatggttgaaactaagtggatgttcagccaagattgataaatgaatgaaagaataaatgaagggaggaaggaacaagcatactgcatgtcagaagggcatactcaaccacagatcaaatgtacagctttgagatggaaattgtattaatttgggatatctatctacttcaattcttagatatacttcaatctttttagctgctgtacagtatcccacagtatgaatgtgctgcaggtaatttagccatacccttaatggtgggcatttaggtcacttcacacatttttctgctgcaagcaaatgttgcagtgagcattctcgtacaaacatccttgcaggcacatacatgcaagcattttgctagggtgaatactgagaaattgccggtgataasctatgggcctttttcattttaatggacacaactatgacattctgggcaggtgaactagcttccaccccactagcagtgtgtgccaagacctgctattttgtatcatgactgcttattatttggcataatgaaagtgttttttctttgcacttttttacccactttgatgggaaaaatatgacttctcattgacatttctgttatgtgctcttaagtaagcatctactcaaatacatttactggataattgcatttcctgttctatgacttgtctattcatatccttaaratgggcctcatctttaatctccttcacacctctatttctcattcgttaaattgggatttcaatgtcagccctattgcatgtccattaatgttatcagaatccagggtgaaataggaagttaagagggaaatagcatttatgcagaagttactctgattcttcttttatgtattgatatatttatcaaatgctgatttagtacaatccctgtgctaagaaccatgacacattctgaagatacaataggtaacaaaaaccagcccggtttctgctctcagcagggcttaaatttagtcactgtgttaaccatcttcacattgctaatatgatttgtagcatttactactggtagcactaacattactgctaacaataactaccatctagtgaaaacttcatatatgctcagtacttttttataagtctaccaatggtgtttaggtattagcatgcctgacttcttagatggagaagctcagactataagagataaggtcattgatttaaggtcccccagttaatagatgctaaagccaagttttatatccctttgcctgaccccaaagggtgtgcctggcaagatacagagcacagtcattgtcataatgactgacaaaggacaagatggtatcttgatcgatggagaaaatgaatactaaaattagatcttcttatttccaaaagcaatagaataaacaccaaagagaggagaaagcaaaatttttttattgtttttttgaacatttaagcagatgaggaggaggaggcttaggaagtgtggacatggccaaaccagcatgatttccagtaacctgttgctgaaatgcatgattcaggctggaccccttcctgagcagggccttctcccacgcctgcccagcatggttttgcctacattctgatgtcccacccaccagaagagatgagcagcatcagtatagagagttgtttttccaagcccagaatgaataccactgctcttagctcaggccaggggagcacatagtcagcacaatctcactctggttctggaaaccaggcattatccacctatgactccctctcatcagtcttggccaagtatttctcagaatgaaatatgggttctgggaatattaggataagcaaaagggcttaacaaaatcaactgatctccagggtcattaacagccataraaktgctatctccaaktgccttctcaattttgaaagggtgaagggctcctgtttggtgctaataccaccaaaattgcttatataaacttttatarattactctaatgcactactaaactttgtagtaagtgaaccattataggttctcttctacagatgggcaaactgagacccatagaagttaaaaattgaaccgatagttccattgataaatttattcatttgtttgtttctacatttattcactcgtgcatttaataggagtgcctactgcatgtcaatctttgtactgggagtgtaactctgaatcttataatctggtaggagagctgaataatagtacacacaaaattataattacaaactgaagagtattatttcaagaggttataatagagtatacatcccccttaaattaagagagagtctgtagaagatgagtaaagagataagaaggagccagactattataaaaagataaaaaataacagatgttggtaagggtgtggagaaaagggaacccttatacacttytgatgaaaatgtaaattagtacaacctctatggaaaagagcatggagatttttcaaagaactacaaatagaactactgtttgatccagcaatcccactcctgggtatctacccaaaagaagataaatcattagaaagatacctgcacccatatgtttatcacagcactgttcacaattgcaaagatatggaatcaacctaagcatccatcaatggatgatgggataaagaaaacgasgtatatgtacacaatggaatgttactcagccattaaaaggagtggaatcttgtcgtttgaagcagcatgggtggcactggaggctattatcttaagtaaaacatctcagacatagacaaatacctcatattctcacttagaagtgggagctaaataatgtgtacacatagacatagagtatggagtgacagacratatggacactcagaagggtgggggaatggaagggggtggatgatgggcaattacwtaaggggcacaatgtacattattcakaccgtagataccccccaaaccctgaattcactctgccatctatgcatgtaataaaattatatttgtaccccataaatttatacaaataaaaaaagaaggggccagattatgaagagtttgtggctcatgttgagtttagatttattcattatgaaatagagggactaaaccaatcaggtctgagattttacaatactgccctggtaytctgtgaagaaaggattgaggaagggtgagtgaatccatttagggttgactgctgaagtccaaaccaaagatgatgattatttgcatagaaaagtgaatgaattggaggtatgttttaaaggtagaaccaacaggacttggtgatagattggattcaagcagtttagtaagaagtagctgtttaatgattctccaacttctggtttgaatatctggaatgagggaaacgttatttcctgaaatagaggaatatattttaatttattgttttgttgggcatggggtagatcaagagttcagtcttagacatattgtgtttgagactcccatgagtcgtaagagaggaaatgctaagaaggctgttaaacacgtaggactgaaattgctcatggctgaactggaactattgccacccatgtctacttacaacatggtaagaaacctctccgcaaagtaacagaatctttttccataaccataaaattactatctcatccaccatattttctatcccacttatctttcagaatcattaaaaataatctgctcaatcctgatgccatccaaatagaaagaaagcaatattctatatggaaaattgtgtgtagttaacataacccttcctggtttagaatgattttaaaaggctttgagaaggtgttttaaatgtgtatttgaatgaattatccaaaatgcattaggcctgttccccatataatgataggaaaaatgtaataggtctttacaatggacctgacacacttcccattaatatataatctcaaacagatatcctaatgtcctcaacagatttttcccccattctataaaagatgctcagataaactatgtaacgggcccacatacacccagctggtaaaataatgggtttgatgactctaagctaggactatttgtgttattatacaagtgtaataattatatccatcatttattggctatgtacaaggcattgtgctaagtgctttaaaaaatttttcttatttaatccttttaaaaaattctttgagcttttattattagttccactttacagctgagaaaactaatgtttaaggacattaagaaacttccctctggaagagttagaggtgagattcttagccacttcaaccttgtgcctcttataaacatgcatgaataaacttgagtggaaagaaacttcctggcatgcaagactattggttagaattgagatgtttctcctcagaaatgatcagagtctagacattgaagtcaagtttgctaaaaagcaaggttatagatagaaaagaaaatgaaggccaaatgcggtggctcatgcctgtaatcccaacaatttgggaggctgaggtgggaggactgcttgagccaaagagttcaagaccagcctggacagcatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaagaataaaaaaaagagagagagaaaataaatgttgttaccttggggaaggagatgatgggtcttgatcatccagctgcaccacattgatagaggaaatgtgtctatatctctcagcagaaaaacaaacagagcaattgttatatgtccaaatatttctatagatgtctatggattaatagtttcatgacatattaatatcaattctgagagggaaaaagaggtctgtgtgtatgcaaggaatgctagtttcaactctattcaggaggtcttgttctgcagaacttcacagaacatgctacttttccttttaattgtgaggctcccagaggttgctgaaatgctttatgtagtctattctgacattgtttgaaaaaggtaccctgttttcttatcacatatcatatgactagcgttactgaggaagctcctttggaaaatgatgagttagtgaaatcaggttgcaatgtgtgtcctggtgtcacctactactttgttattttctgttcactctgggggtaggtaggatggactagacttggttgtgctgctccaattcctgatttttaagaaaacaaataaatgaagaggaaagagaaggaaaataacagctgtcagagcaattacagatgtgagaagaatggaggaatttatctcacactgggcattggcaagaggaatggacaaaatctattcagtctgtgcttggagacactgagaatcatgagggcaggtcttggtgggtttatgttgtgtctgttaaaacacaacctcagacaccactttagagatgctgaatttggaatcaagagatctgactcccacaycagcaccagccttgctgtggaacagctttcttccattgtttaagcttaagttccttcccttggacaaagtgggtgactgtccatatagtctaacaaggagtggtgggaaaaactgataagataatagacttgcaagaacatgatgcaatctagtgaactgtaaagatttaaatgttcatgattctttctattgtttgatttttcactacgcttgttcttggccagagccatgatagagagtatgtgtaaaaggcaaacactctgacacatacagacacacacacatcaagcagtttcccgtaaactctaccaggagttgctatgcttcagtgttgggttagaagaaggaaaagataaattgtactttaacctttgtaactgagctaaagaaaaaataagagagaaaacacaccatgtgctggccctggatcaggagacctggattctagtactggtatcctgaaattttgttgtgtccttgatcaggtgggtccccaactgtgggcccaagacccctgtctataaaataaaggggtaggtcatagctctgaaattctgttcagattatcctttagctctcacctgcactcagtgcatctaattaagtaaagacggaggcagcaggttacatgtcatgttgttagtaagtctgaactttgagtttgggggctggccatctagatctaaagaaagcctccaggcacagtgggactctcaggactccacctagacccagcctctctcttaggacttacaaagctcttcctttgagacaatttcaaaatgttttggtgcatttttcctggatggcattttaacttgacactgagatattagaggtgggggctgtgtaatatctgccatgttattctctacccctagcttcttgtgcaaggccagacatcatgtagatggtcaataaatacagataaataaatgcatgcatgcatgaataaatggatcagtaaaccctgtggtacatcaataagtggtcagaaaatcatgataatacacatcatatctggtatattgaaggtctttcttttaacttctaaggtggattagttactagaggattgaaaggacaaatgagaatcttacagcatggtcactgctcctcttggggcctcagctctcttatccttaaagcaaaggcattgggccagaaggtgtaattctgtgtttcattcattcaacaggcaattatttagcactgtctgtgtaacaggtcctatagtaggcagtgaagataaaccagtcagtaagggacatactagcctttcaggagcttagtctacttaatgtgaaagtaaacacataaacaagtgatatctaacagtgcaaaagctattatgtaaagggaagcacatgggctaagagctcctcactcagcttcacaggttagtgagaatctcctgaaagaggcagcaactaagccaaggcaagaaaatttagccagggaaggaaagtgagactgcttgctcagggtggtggctgagggtaaaatttcaagaagagagtttgagcaaagaggccagagaagttgacaggggttagatcatgatgatcccagagttcattgctgtaaggtctggacttcatcctgagagtggtgatgagccattgagtgtctgtaaggtaagagaagatcttcattagatttggttttaggacatctttttggctgtgtgtgtatgtctggatagaagtaaggatggaggcatagatcaaaatggtaaacgaggaaaagcaatgttgccaaaactgaagtagatgatggcacttgtctatggtggtcaagtggaaatgcagagcaccgggtggggctgagggatattaatgggataaaatacttggaaaactaatcaaaaggaggaggcaggtgagtgtgttatgaaagatgcctgtgttactggcatcactgaaacacacaatgaatgcagctatagaggcatatttgggttgggatgaaacaaggagaaggagttcaaaagtgccttccagttgctggcctgtgaatcagaggcaggcatacagggcagttcaccttcagccacaacatttctttcctatgcagagatgcaggagcaattgaggcatacatatgcatgtttgtatgcatgtgtgtgtgtgcatgtacatgcatgcatgagtacctgcatatgkgtgtgtgtgtgtgtgtgtgtgtgtgtgtgtgtytggagcaggcaaacaaagacctgtgagaccacctgttttcatcatctgctgattctcaaagtgtagtccaatgttctaaagaggtcccatggggtatcgggggttaatcttccatagaactaatacctataacgttacaaggctcaggctttgttttctacccaggattaatcattcactcatgggctttaatacaagccagacacaacctcactgtgcaaagcaatgccagctccccttccattctgatgctagcttttacattcttgttgtcagagtgggaactaggtttttgccccagtttcagaatcctatgaagtgaaaagtttagaaacttccatccaaggatgttagtcaaaaatgccaggacagctggactcagccattaatttgccatatgacttgcggccatttatttcccatatctgggctttagtatccatcccacaatgagaaacttggagtaagtgatattcaaagtcatccagctctgatttctacatatttgtgtttccttcttgagctaagctctgtgtatacgaagtcagtctccaaaaattttaagcagagaattttgagatgcttgaacttcttactgtctgggaattagactgaaaaactctcagaccaggaaagattattgaagatcatctatgccaggactgacacttgacatatgagagaattgagctgaaagaggaagccacttcttcagagtcacacagccattcaatggcagaacagagaattgaacttagcgctcctaattcccagtccaggtgtktcttcccctatgtaacagagtgtkggacattggccaraccttgggactcacatttgaactcagctccctctgatcatagagaagtctcccttgtttgctgggaatgaaatcttagagagctgacatagtaacgtcatggcagctggtgccggtgatggggtkggtataggaaatgagagaacacatttggctaagctcagggttcatgtgaccctccaagagtcttaatttcaaaacaaactcaaccttttaggttcaagttctctctctcatcagaaatgtgacttcctgcttctaagaagcaaggcttacaaaagagctcagaagacttcgtggacatcaaatagctcttacaaaatagcgttttgatgagttaagtgtaaatgaatcagaaacataaggattacattttccccaagtgcacatgggtttcagaattgaggggaaatgtagtttgctaactgcacgctggttttcatggaactcaagccactcctgggaagggtaaggggagagaagaaagagaagcccagtccccaaatggttttagatgtggtgccaaattcgaaaatgctgttgggtttgccctctgccagtaataaaattgctggccacccagagaggccacagggaggagaaaggagatggctttccttactggcccctagtcctccacaactgtgttcagttagtgccgctcaatcaccagctgtcactggggccctccgttggactccctggccctgacttggcctcgattttcacactctgcagcatgcctgtttacctccaactgtatctggtgttttggctcccagagtccttggtgactggtcagcttgtcacaagcccctgctctgtaatcaagtgacctgtccatcaccagtagaatgtttggggaagctgtcacacatcgcctttggttgcattcaggaaaaaaacaagagttctttgtagatcttttcctctctcccttctttaatgctatccaggtgtggagtttcctccaaactgttaaatgtcttcccttcaaatctcagtctgacacaaattaccagttaaatctcaggaccgctgttacctcgtcccrggattcgaagctctggatcttttataatttccacattgtccctccattctttcccttctattttgttttattgcaccaagaaagtagaaaatcatttcaattggtggtaaaagatgattaaaacaaaataacaaaggccttggctgcaaactgttagttttattaaattggctactgtgttttaaattagtaccagggcaaatctttggacaattatatcaaagattgctggaattaatcagtcacatgtacacaattgctcctttcagagccttgtacagagtaaggatgtcgttgccagtaggaaaagaatgagttttgcattacctgtgtgagagggatggaccctagccccattgagaaggaatccaaatgcccaatggagtctcagatctctgtcatctcatttttcatttatttaatccagacaatgggttggagctcacagtgaccaccaggagaaataagaaaatggatgttacagggcaaaaggccattttcccaaagattttttcttggcactgagtcctcagcatgacagctttgctttaataagggggcacctgaagtggaagggctgcagtctactgagtagctgggtccagaaagagggaagatgggtgtggtgggatcccaggctatacaaagactggaggcagattcagtatctcaactacccttagcacatctaagttctgacttctacagctggagataggctggaggcttggagaattattgcattcagttccttgcgtttacaacagtgattctccgtcacttgatgattcaagccccaacatctcacctcagagcctcctgccatctactgctcactccacccaaccattttagcgaaacgtttccacttcctttggtataccgtgaatttcagtctaaatgaactgttcttaatctagaaaaatttacctctgtctkgttttatgctgtttctactgctcagagcactatacttatcactcacattttttgatatgtgtgctttctcaaactattaattcattcaacagatattgctgagaacttattctgtgctaggcactgcaccaggcacagagatacagcaaggaagggctaatattctctgtccttgaagcacttaacatacaccaaggtagtcaggcattcaacatgtgattgcaaaatgtgtgctcacttttgtaataaagtatgggacactaaggatacctgtggaaggaaaccaacatwacccagctatcaaaaaaaaaagcctccctaagcctttctcgttctttaaaccactatttggtcttcctctgctagcactctccaaactctactttgtgttacaatcacactctacttggtttatcctctcttttgccctttgaactgtttgaaaccaatggcagtatcttcttcatctttgagtcctccattttgactgagcttcatacattttttwaaaaaattgaacaataaaagtgatgtccagagaaaaatagctgattgggccacaatcacaacaaaaactaataaaacagtagccatttttttctgatacttggtccacagtcagtatgttaaactatctttcaaaacatttcttcccaagggcatacaatacttyctgtctcagatccttaccaaccacccctcaccaccaataaaaagtgagaccaaagtacctctcagtcaacagaaataaaaggtttccttaaaaattcagagtaatactcagacaaaattggaattaaggcatacatagtcatcactcagtggaaaaaactgtgtgtatataactttaatatgtgaatattaagaaataaattcttttgagaagactaatcacagctccaacgccattcagtaaagaaggacattttgtaagttttagttattgttaaataaaatagaatataaaaatatctagcatactaccaaaattttctaggtactcaatttattccatcctacagggaatatttggtctctttgccttcaggtactgccttttcaactttccttccaaactcattatctatactgctacctaaatggtcttccaccaaacaagtatgatgatgtcatttgctgggaaagccagtcctttcctctttctcctgatgacttctgactttctccagtcaagccagtatacctccttgggaaattttctcactccctccccatcatcaagggtaagaaaccaaccctctgtgctcctacagcccctacattttttaggctgttttaaagcctcaattttaatgttgtctcttccttgccatccaatgagcatcctaaaagcaggaccataatgtgttcatctttgcatcccagaaaccagtgaaggctatttcgttggataagtgtaagcatacctaaaacaatacaaatatatttattcagaaattttaaaaaataatcaaaccataaatataatcagctagcattaagctactatctgggtttacttgtcagtctttcttcatgaacactaaatatgaaatgatattacaaatttgtgatcttatatttatacaaaataatgtgtgtatgtgtgtttacacgtagaaagatactgaaagggccgggcatggtggctcacacctgtaatcccagcactttgggaggccagggtgggcggatcacaaggtcaggagatcgagaccatcccggctaayacggtgaaaccccatctctactaaaaatacaaaaaattagccgggcgtggtggtgggcgcctgtaatcccagctactcaggaagctgaggcaggagaatggcgtgaacctgggaggcggagcttgcagtgagccaagactgcaccactgcactccagcctgggtgacagagcaagactccgtctcaaaaaaaaaaaaaaaaaaaaagagagaaagaaagacwctgaaaggatcctgaccaaaacgttcctggtagctgtctcaggataatggaatttgagattattctactttaattctttcatatagccttctaatttgctataataagcatggatgatttttattttggggagaaaaaagcaattgagattatatactgtcacttcccagtctttttttaaaagtcagcttccattctaaagatatgtttgcgttgaaacgattgttctctacctttctacatttaaaaaatatataatataatatactctgagtttcaccttcctaaaatactttagaaccataaagggaagcttgttttatcttcaaatagtttttgtggtctgtattttactggatattactatatggctcactagggtgtgcccatccaaaaagtcagctcaatgtcttggaaagataaagggttctagagtcaaacagcatggtttaaatcttgttttataattgttacatctctgacattgagcagatgactgaactacattgaatcgcaactaaaaaattcaaataatttctgcctttcaggtttatattagaaatagtatggaaaatttggtaaagtaactaaactaaaaacttttccaatatgagcatccattggatattctagataaaatattacagatataactagcatcctttaaaatgcmtgattgagattagaaaaacagaaaaggatatttccaggggcaagacatgcaagaaataaaatagaactgggaactaaacaggtaaaccctggatctaaatttgtggttggtatagtttggataagggagagccatcagttttggcaattgagtggcttgaatattcttgttcaccccaggagagatgtggctttgcaactctgcaaggtagtgtattgggactaacacttttaaaataaggattttaaatgagattttcaggacccctgaaacgacccctgaaaatctacatgtttggtgaaagggtgtactagggaaaaaatatgtatatgcatatgtctagctacctaccttaataccatgataattaacatgatttgatttaactgtcatcttactatctttgcctaggatctaagtggaaatttataaccattgtcttatacctcaaaagacttgatgtttgaatttatactgctcagtatggtgtgaaaatgcctgagctgaaaaattaagtgaaaaaaaaaaaaagattccaggttagtgatgttgcagggatacctagaaattaacgtaaaatcgctctgagggaggacatggacttgacccagggagcacatgattcccacagattaaaacccactgaatctgaaaattaaaaacatgaaaaaagtaaacaaggcatcaaaataagggtcagtaaacaacctaagggctttttactaaattttgactttggtgagaagtatacaaattagtattttagaataaacagaatgcaataacaacaaaaaataaataaaactagaaagtacaattttcacagttaagatgaacaaagaagagacaaataatggaaatttaaaaattcgataaatccaagtgaagggaagaaaggaggaaaggaataaataagcaaggaaaaaatggaaacataagtcattatactaatcagattaaagccaattggatgaagatagagcttctctagtcagatttaactcaagagttttgctgaaaggttaaaggtaaaggtggggacaatatttaccaggtaaatgctaactaaataaattaatatagttttcagactaaggaaacatttggcaaatatgttactgtgatttaaaaaaagaagtcaccacataatgataaaaggaagatattatgatttacaacctgaatttatgaaataatatgacctgaaaatatataagtcaatgacttttacctaaaaaaagataaatgcatgacattgtgatattttaacacatttttctcaataatttatagatcaagcaaactaaaatatagtaataatctagaagatcttgaacaacacaaaaaagtttgagctgataaaaatgtatagaaccctgatacagaactaaattatgaatatttccttcttgaatagagatgtagactattttttaaagttttttttttaccatgtactaggccacaaaacaaatttaaacaaatatcaaagtatcagtatcagatagaacataagctctgtccacaatgcagcacattaacaaacaaaacacaaataaacaaatgaaaaaggtaaaacttttcaatcaatggaatttctaacaagcgaaaatcttatatatttgccaacagaattcagcaatgtattaaaaaccacatataatgttaaagaggtgactttaatattaggtggtctattaatgtaattcacaatatttgtgaattaaataatttttaaaacaggaatttttactagatgtagtttttaaaaccctgtaaaatcagattccttcatgatgaaaaaattatagtaaactgggaataagtacaatgtaaaaagttttttgatcacagggtcatcttcagaatgcccagttttgccattggtctcctacctagcgcagctggacaaaaaataaaaacaaaaggctgggcacggtggctcaagcctgtaatcccagygctttgggaggccaaggcgggygkatcatgaggtcaggagatcgagaccatcctggctagagacggtgaaaccccgtctctattaaaaatacaaaaaaattagtggggcatggtggcgggcgcctgtagtcccagctactcgggaggctgaggcaggagaatggcgtgaaccccagacgcggagcttgcagtgagccgagatcgcgccactgcactccagcctgggcgacagagcgagactccgtctcaaaaaacaaaaaaagtctgaggattgaaaaggaaacgacaaaactaacattattcttcatctactggaaacaatatagaaaaattactaagaatcaacaattactagaacaaataaaacagtctatgaggacttctaaatataatataaatttatataaaactcaattatttttattatccccaaactattagaatacaaataaacctacacgtaattatgtgtatgtgtgtgtgtgtgtaaatagctagataaaaagctactatttactgtaggactgacacctataaaatgcttagagtaaggcatatattgctaataaaaaatcatcaccatttttataatgaaagctttaaaactttactgaaactataaaagaagacctaaataagtaaaaagataaactgtgtgcataaatgggggaagacacagtatcataaaaatgccctttctcctcaaatacactgatacattcaatgaaattggaatcaaaatcccaacaggcatttgtaaggagaaagcttcacatggaatttcacatggaagagcaaggggcccttttgaaaaggaaaactatagaatgaacttataatgtaaatcaagacttttatgttgctgtggaaatcgctatagactgctaccgataaaacagtagataaaaaatagaccaatgaggctgggtggcatggctcatgcctgtaatcccagcactttgagaggccaaggcaggcagatcgcctgaggttgggagtttgataccagcctgacgaacatggagaaaccctgtctctattaaaaatacaaaattagccaggcgtggtggcgcatgcctgtaatcccagctactgggaaggctgaggcaggagaatcccttgaacccgggaggcggaggttgaggtgagccgagatcgcaccattgcactccagcctgggcaacaagagcaaaaatagaccgatgaaacaagataaccccgaaaaaaaaaattatgaaagtactgaaatgatatatggcaaaggcagtattacaattcagtagtgaaaggattaactgttatcttaaagagattaactagtgctggacaaataattttaatacatatttggggggaaaaacaatccttatttcacatcatttaaaaaactatactgtgggccagacatggtggcttacgcctgtaatcccaacactttgggaggccaaggcaggtggatcacctgaggtcaggggttcgaaagcagcctggccaacatggtaaaaccccatctctactaaaaatataaaattcgccaggcatggtggcacatgcctgtaatcccagctacttgggaggctgaggcaggrgaattgcttgaacatgggagrcagaggttgcagtaagccragattgctccactgcactccascctggacaacaataatgaaactccgtctaaaaaataataatagtaaataataataataataataaaaacctatattgtaggtgcttgaaaccatataggtaacaaacaaaaccttaaaattattgaaaggaaataaaagagactattttatgatcttagattaaaggaatgtttattcaacaacataygaaaaacacaaatcatgaaggatacaaaattctcttatcaacaaagcagcataaacataatgaaaaattaggagtcatagaccatgaaatggtatttacaatggctttaattataaagaattaatatccagtatatgtaaatatacttatgtattaatatagaaaaacaaaacttaatttaaaataggcaaaaagatgaacaaacaatatgcatgactagaaacctacttgatccacaaacatgtgaaaagatactcaggcttgttagtaatcagggaaaggcaaaataaaacaataattaagtatcatttagtaaccatcagattgaccaaaaaaaattacatatttggcagaatcaagtgctgacaaggaccagcactttgggaatgggaagcctttgtgcagatgtgttaattgatacaatcattttggtaaatactttggcaatatctaatagttgaagatgcaattatcttaacctaatgataccattttagccttttttccctcagaaaactcttgctatgtgcacagaggaaaagaacacaaatatttcaagtaacattgtaaataataaacacagtgattaaataacaataatagcaataataaaagaaccaacctaggtatctatcaagaaaagaatggccaaataaattatgatatattcatatggtaaaatatttatgttagtgaaaataaatacgccagatctacttgtagcaatatgtgtgatctcaaacaatgctaaggaaaaaagaaaaacagccagctacaaaataagtatagtattgaaacatctatgaaatttaaaatatgtaaaacaatacactgtgcaaaaagtgtaaaaatgtgcatgggaaggaaatgagatacaggaggagcatacaggtgggtttaaacttgatcagtatttattcctttcacaccaaaaacaaaagatatgaagaaaatatggcacaatgttataatttgacaaagctgtatagtaagcctatgaaaatttgttatagtatagtctgtacttttctatataagtgaagtattttctaattaaaacaataataatagcatgtatagtctttggcacatcatctcaggctcaaaaagtgaatgtttccttcccttcccattcttggctggagggttatatacaaagtgcccagacattaccctctggttcttagctcaaggctacactggaatacttggactcttcctgagccaaagkcatcctaggtggtcccatcttacatcttctaactcagacaatctgggtggtaggtccagacctacacacgttctcagtgcagaattttaaatgctgaagcagtttctagcctatggaaaagctcaagacataaggatacaacacaacactcctccttaaattagacccatggattgcagaactaatcatcacatccttcccagattcttctttcatagttaaaaaaaaaatgggtggacagaaagaggaaatggcttgtccatggtcaatgagtcaacggtagtatttcatagggaaatactatgaaattaatacagaaaaacaaagatttggaagtcatgaaacacaaattccaaatctttcaactggtctttgtatgtaaggtctttgtgatccaaaacaaagtcttttgatttctattctgctgtactttgagaaagcttggggcttctgtctttggaaagcactgtcttggaatggagttagacagaactggttcaaatccctactccatgacaaaaatattgtgactatcggcaagtagcttaatcttcctaagtgttagtttcctcatctcacaaggaggataattattcgagggattgttcttttggttgagactgtaaatacaaaatatgatacgtagtgcgtagcatataataagtaggcaacacatagaaactatgatagctgtttttattccagaggatgaagttttaaagaaatataacacagtttagttatagagactatttgaagagatagacaatgataaacgaatgctatgatatagaaacaataggatcaataatgagtatttaaggagctcagagagagttttctggaagaagcaaaatgtgatgtttccatagggtaatgagcctgtctctccccttcctcctatatgacttttttgtttcttatttgaccttcacagtggtatgggacaagaatcaaacatcctaattaaaagacagaaaaacagacccccgcaaaatcacatgacttgtctacagatttcagataggttttaattgacctatcatattaactacataccaatamactttaatttatgcattttaaatgcatatttaagcttaagtcataaggtgcttaccctccttatgtatatattaatattttagataatgatttcacaacctgtaattaaattttagtgtaagttgtgctctaaattcgatacacatttaccatcagtatgactttctgaggcagaatactgagatcatatcaaccagaaatgccagcatttttgtttctaattatcagaaatacaaccctatggcacatatgccatttgcgatatgtgttaaagaatgacggttaaatgtagaaaaaagtgttttgttttgttttgttttgtttaaaaaaaaaatgcatgagggccaggcacagtggctcatgcctgtaatcccagcactttgggaggccgagtgaggaggctcactggatcccaggtgttctaaaccagcctgcgcaacctgattagaccccatctctacaaaatatattttaaaaattagccactgtggtggtgcatgcctgtagtcccagctactcgggaggctgaggtgggaggattggttgagccagcgagtttgaggctacagtgagagctgtgacttctgcctgggtgacagagcaagactgtcttaaaaaaaaaaaaaaatcgcaaagattccacagaacaacccttcaaaatagacaaacaacttcatcacatttaaatatattagctacaaacataaaatattcagatgcagactttatgatttactactacggatggttgaagtttaaaaagaaaaaacttaaaatggcattcagaatttgatgtgagaaatcagaagtagccaaaataatcacatctcaggtgatctgctaaaattttagttccaaagaaagagtaaattggaagtttcagcttggtagcaagctgctgtcgctgcactaaatgaaaagattttgagctggacagtggctctaaatttaagaatattctgacgatgttggcaagactggaaacgggatatgcttgaagcaggacattaagccagaggctgctttggccgtcaagattgacatatgggcctcaggagagctgaagaaaggatgacgtggaaactcctgggtggggagaattgagagggcttagggtccatctgaatgtaggaggcacaggaggggaaggagttcaagtgatagcataaggctttccagatggttttaggagcagctgaaaggaacaacttgacaaaaatgtcctacttttagaccaacaatgaaataggttctaacctccagcaaagccttcagaagccactagcttatccttctgaaaraaatctattctacctaggttcttgagaaaagagccctcatttaacattaactctgacttaaacttgggtaaaatatagttttatcataggaatttttccrtggaaaacataatctttttagtaactgytgtacccatcccactgtccccaccttttaacttaagggagtgacttgggtttttatttttcaatctgaaaacttgggataacaacaccttcctcaaagagctgcttaagcttctggaaaacaatgaaatatgaaccacacacacacagctagaagaaggaaggttattaaggtttctgtactaatcaaatatgatgttagtggataagaaggaggtcggtgggtagacgttacagggacacagatttcgccccagggtaaagagaaaccttctgggatccagaattttcagaagctgaaatgggtcacctggaaagagagcaagctgccaggcactgggggtgttccagccaagtgaagtagtagaaaagatattttcatcaagccacggcacacatggtagatgatggctgcatcttcacgggtttgcctcaccaaggttacattacttatttgtctctccatctcttctagtaaggggaccatagcataaattcagtggacaggaatgttgataattaaccattaattgtaatggattaacatttattaaatgttcgtcataggctgggcccatatgtgctttataattgttctcatgcttcatctgcagataaatgctgtgaagccaggtttatgactgatttgaaataggctcagaaaggtaaaacaccggcccatgacttcctggctaataagtgaggcagccaggacagaaacacatgttttcttgtctctgtgttgatatttattgaggaaaaggaggaggaagagacgcgacgagaggacaaagtggagagaggagcaaaacattcacaaatattagccaaccaccttaaatatcatcagccgcaaatcactcgtgacacatgccagaagtgaaaaacacaatgtagagaagtacttttcatactcacccttttccagagaactacccccatctacttagacaatgactggatagccccagtggactgggatgtagtctgaagaaaatttcttattttatatcacaatgtggccgtttaaaaaatataaagcatgcctctgtattttagaaaaaaatgaacgcataatacaaggcatgtcatatttatcatgtacctttgtgtatcccctgggattgttacttttttctccaccccactccagttttagaattatcaccaggtgaagtatatgctcattagtctagatgtggataaagtagccaataagctaaatgaaatcataaaccctataattctatcaacaaattaggattcgaggtttacaaaacaaccatcaytcatgcataaaaatctctcaagatattggtatgtccacctatttcatcttcattggcagagcactaaatctccagggatttttggtctacccacaatattagcagttccagtgctgctaaaacaaactccctttggggtaatacatccaacattctcaggaaagttgtgttctttcccagagtccttcaatgctcataaactccagctcattattgtgttgagagtctgaagacattctctgtccattgcccctgcacctgttatcttgttggccttaaccaaacagcccaagtcctaacagcagctgaaataacagacgggyaggagaacttgagattttttgacatcatccttttgtttatgaaatcccccccaatgctggaatctgacaggaattctcttcattatcattttgtgttttttcccatggtactttgttgttattaaaaaattattactaaaaataattgatgcagaggtagatgaaagayaggaataacatcttcatttgaaaattgtcaaaaaggacatagggagggggatgtggtcgtgtggaattgacataaacatatatttgccttggaggataattggcagtagctgtgttcatttggtggtgtgtttgtgaggaagcccaagcaggtactaggaggtctttaggtcagaggagagatgcagtctaggcaagttggaaatctggcaggaagcagtccttggaattgcgattcccaggacatgacccaactttgcaaggggtgaggttattaaaacagacctaaaatagggataagataggcagaatataggatatcacttaatagcatatgattgtaagcaagttgctttaccttcctatgcctcagattcaccatctgtaaaatcaacatgtaaatactagcagccatgtagggatgttttgtttctcaaataagaaattcatgaaaagtgtttagcctaaggccctatattctattaatggatgctgctattattattattattttgtcgagagtgaaagaaatagggagaagcaagtggcagggaggcagagagccactgtacacacagcatcagaaaagggtttgctcacgtgtaatggagtttctgctcaggtcttaaaatgaggaaacatratcagataatgccctaagaatctgatgtggtgctttcccacctctrtgcttttgtttatatttatttttcctggatggcttcctcacaaacgtcttcatttttagtcatttgccatctgatacttttccaacagggttgctgtataggttaaattaaagaaaaaaacaacacctagtaagtacatagttatcagtcaattgatgctggttattactgtacattttagtgtagtccattatacttagctaactgatgtagccatagtggacaatagaaagtattggatagctaaatgtgcrtttgatttcaaaaatgagcaagactgatagaacctactccaggggatcaattttccattctctctttgtctgcccagtattgtaattgtataattatgtcttctttgtattttccagggatctaaatcttggcagtgtgtaccagtattgggtcataactatttcaggaactgaagagagtgagccatcacctgctgtcacatacatccatggaagtgggtactgtggcgatggcattatacaaaagtaagtagatctaattaaagaaagaagaggagggatgctggttaggtcaagagatggttagggtgctgaacagaagagcttatgacatattcttcagtgcatgagctgtgagctactagtggtccccagcagtctctggattggtctccaaacaatttgctgaactcagaagaaaagcaatgactctttttgaacacgtacattttgcgactatgtaatacaatatatgatttagacagaactacccttatgtacctactaccatttgctcttgctctcagttgctttatgtgtgctacaaggattccattagatttttccctcacagtcacagcgtacattcagttaacaggacacagttcatctaggttaaaacacttttaagttctttgctggttaccattcacatttatgaaaactgcatatttatttgttatctctattgtatcatattatacaacaatttacaaaatgggtcaaaggcttataaaaacagtgragtattttaactcactacaatgtttaaaccataaataataaacagtgctctggagtgaatattgaatgtgaatatgagtacactgaggcaaatgaagcatcatttgtgggtccaatcagtaagtgtggattttatcagattatcaacccattcatcttcctgttctcaggacaagatgctatgcaactggcaaacaggggtgaggagccaccaagacttttgcattgtttaaaactcaataaataaacttttaagtgcttttcctccagaataagaaaaaaagttttctagtacaaaatagagaattttgtctctagaggtggaaaagagaccaataattattcaaaattaaatctcttattgctaaaattatgttcctcattgctaaaatgtttatttgcaagtcacactattgctaagagactttttaaactattgacagatttaatgataaacattacatgtggagaaggcaaaacaagctattggcaaaattccttcattaaatagcactgttgggtgtcacataatatctgtgcaatatggaattgcaattactatttctataaggggaggggtggtatgaaaaaagaatttgcttcacagttggatgaaaccactgatrtgtagaacatgaatcaactcgtaggagtagtacatatatgaaagagacacattagatgactctttctttctgttcatcactaacactaagctagaggggaagaacaatttaatttgtttctgatgattttgtggtatggaatgtaaactggaaacctctgctttaggatgaaaggaccagctaggaatacagcaaggatgatgcagtaatgcaagtgaaaagagctggcatataaatactcatccacatagacatcagttatttgccagcagtgttctttctgaacatgatttaacattaaaggcaatagaaatattgcaaacatgatcagatgaktggtaaattatatcttttaaacttgctgtgtaacaagatagtagcatgtacaagattctgttcctctttgctccccactccacaactaaagtttgccaactgttaatgaaaagataccaactcaagtttttaaaataagaaatggcggccgggtgcggtggctcacgcctgtaatcccagcactttgggaggccgaggcgggtggatcatgaggtcaggagatcgagaccatcctggctaacaaggtgaaaccccgtctctactaaaaaaatacaaaaaattagccgggcgcggtggcgggcgcctgtagtcccagctactcgggaggctgaggcaraagaatggcgtgaacccgggaagcggagcttgcagtgagccgagattgcgccactgcagtccgcagtccggcctgggcgacagagygagactccgtctcaaaaaaaaaaaaaaaaaaaaaagaaatggcattaaaaaaatattggcactgatgaggcaagtaattatttgcataatctcaagtggctttctgaagcaggaacatagcaggaacatatatgtatatttatctatatatttccggatcatatatttatttcttaaatgtcctacacctaaaattttatatctgaattgtcaaaatgtttaagattgaagagattagtgtaagggtttataagtgttgcattatggtgcaaatcagctgattgccaagaatttgactcctcaagcacagaatagaaagctcctcacttgtttgagctatttaacatacaatgctgtatgtatttaagatccacattcatatgaagcaacagaacaagaagatacagtttccaatgcagtaaaattggggaaagggaaacttctcactgttctctcccacattaatacatcaaattccagcttttgataaagttgctgtctgakggaacattgaacaactaaacagaggactctccatggagaaagtaccccatcatttgtgggtccaagattgaacttcatatctagactatccagaaaacatttgcagtcactggtgataactcataattgtgatttgggaatttctaatttagcccaattttttttttaagtcatcagatttggagcctcatctacagctcatctcagctcatggtggaaacagatatagatgaattggttaaacactgcaaatgatatcattcttgctgatctaaaactattagtatcataattattattaattttaaatagtatacttaatttaatacagtttttttttagtatttttacctagaattagtatctttcataaacatcaaacacatgttcagttacctgtagatatcaaatatttgttgatatactttgtagaaaactaaatttagcttatggatgtttccctaagtaggggtgggggggtaggggggaaggaaaactttggggaaaagaaagggatatcatcttagctaatacgatttttcatggaatgatgcaagttaatttgctctgtctgtaaaataatttatgaagaaatatggatagactcagcactcagtgaggcccttaatggatgagtgctgtcttaaatgatccatagcaacaggttctacatttgatagatcgggtaaaggtgaaggcaatggatgaacgttttgataatgacaataatatttatacacacttcttgagtctctactgtgcatgaagcactgtgctacattattgtctccttgagttctcccacccaacagccatgtgagataggtcttattataatactttacrgataaacaatgaatacacaaagagattacagaggttttctcaagcttccacatctggtaagatgtagaaccaatacatgaacagagggcccagattctcatctggattccccattgcattgttgtgtgatgtgacaactctgcaaaactaacaagtaaaggagtggctgcatgctgtctgttatatcctaggcactgtgccagaaactggggtgctaggatgatgaagactctgtcacttcctttggcaaattacagcctcttataaggggctctcaagtaacaggcaaaggcagtcagtttgacaagtgctgtgatagatggagcaagatgtctgtggacacagagaaagatggccacccgctccagccccagaggtcaaataaggtttcgcagaacttctttatctaatgatagatctgtcatgcctagaagatatttgtagtgacccgaatattttgtttaaaccagtagaacactgtttgggtggcgatggaagggaggttgaaagtaagctttgtggcttagggaaccagcccaggtatttttttgtttttaaagtcttttccaaaacaacctatgcattagcttagaagcacaaggtcatcggcaatttccagcaagcaagacccactgccagacaatgctgagaccagctaaaaatacaaacttcttctttgctcataggtgtgcagacaggagaggacttgggtggctccttggagatcaattcaatgccctagccatcttaaggattgattgcaaggcattatcctgctactctgacacctyttaaaagcaacaaacattgcccagtgttaattgcctgggtgaaaggaaaagtctaaggcctcttccatgctgtgacaggtcccagctggtctctggggagggagggacagctgtcacacactctgcagagacctcccaacgcaaagtgggaatggggactgtgattccttgagcatcttctatgtgtcacccactgtgccaaccactttaagctactcagaggcataggactaattatctccattttagcacatgagaaaactgaagttcagcatccacaggagcactgttcaatggatttttctgcaatgatggaaatgtgttctrtgctgtccattacagtagccactagctacatgtggttcctgaatacttgaaatgtggctactatgactgaggattggaattttaattataattcatttcaattaatttaaatgtaaatcatcacagaaatatcagatcaagaggtcaagtgactttgtcaagattatacagttagtttgagacatggggttctaaacccaagtgttttgttttttaaaggatgaccgttttccagaaagcagtaacccatccagactttcaggtgttgttcctccttctcatcacctaagcccaattcaaagatcattgctcattttctgcccatcccaaccctttgcaaaatcatccttaggtggtggaaataattccaacaaaaacaaagggggcattagtatttcataacagtgtagtctcgcagcccttggagttcttgacaccaacaaatgacacacccgatggagaaagcaaaactttccaatggaaggatgactaaacttgaatgcatgaatgaaaaaaaaaaagttacctttaagtatattgggggaataagaaggatatcaaggcagggagtggtgaaggaccagaatctctacattttccttcaaatatgctttttttaagatcagagacaaggaaatgtctgtgagacttcctagacactgtgggagcaagaccatttatttgttcattagttcttccatgtcttactcccatctgacttaactgacttgagatctcagagaatgagttggaatcaggacttctactttgtcatcagaaacacaaagcaaggcaaatgtgaaagtatcttataaatccataccttttagaaatctcattttgaagatgaagaarcagagactcagacagagaaagggatttgtgcaaggtctcactgaaggttcatggcccagggagggacttttccatgtccagccatggttttaagactaaattggcaaatttctcttccatatctgctctgcagagaccaaggtgaacaatgcgacgacatgaataagatcaatggtgatggctgctcccttttctgccgacaagaagtctccttcaattgtattggtacgtctttttcatttcttgtggccttcatgaagaaatgaacggtgcagaatggttggtcaatgataatgccaacaatagttatgactaaatgatgattcactcctttgtattacacctgtttattgagtgcctcctacatgccaggcactgttttcaatatcgggaaatacagcagtgaaaaaacaaacaaacaaagcaatccctcaagagcttaagctctcatagatgatgccaatgacgggtaacttcttttgatcaagctttaccttacaaacatccctgcttttcttcacactaactgtccaggatgggtattactggagatgttttaaggcttttattcctacttcagagataagaaaaaatcaaacgccagaaaaatttcaaaagttgtccagagttatacaggtcaaaagtgattaaagacagaatcaggacttgaacctgattttgtctgattctcaagcacgtgctcaactcattttgctttgcaacctccagccgtgatgcaggaaccaccaaggtcccctctgcagactcagaaccttgggcagtctctctgatctgaggaaggaggaatagcagaccagcctgtgtttagaaagcaaatgtccttttcccaccttcaccgagtcatttgggaaatttgttttcctctgccttctcttggagtctggctgatcttgttgtttcagccccacttgggaggccctggtcagccccgggctggtaaacagacaggggttgggaggggcaggggtggaattttgagctggyccagatgagatcatacttcctttaagatgcaaatcgatacctgaagatcaaaggtcccccagctaatcccctgggctggaggtgaaaactaatcacaattcatttgcaagtacaaaagacagaggtgctctatctgaagagagaaggggcagttacaagcggatgaaaaccttcgtgggaagatttctcactgacaggcaattttctaggactaaagaggaaaagatagcattgcatcctcgcatctgcagtgcattacaggggtgcatttagacattctttctcccagtagattgtgagctccgtgatggtgaagaccatataccatgtgtctcttattcaattctcaacacgcatttgttgagcacctactatcttcttggcacccagtaggggttgagcaacacaatagaagtgctctgtaaatatttatggttggaagataggtagatgccccaggagaaaagacatgggagtttctaggcagggccttgggttttaaattgccaaaaaattttctctcctctgttgatttgaatatggtccggtccctagtaaaagcttgatattagcctagtgatgtggtggaaagaactttggattaaaattaggaaaaccaggttctagtaccaactgtgctgagaacttacataaagctggccaagtggcttccctagtcttggcctcagtttacctactgtaaatttttaaatgattgggttaagtggtcctaactcttaacttaagagccttacctgcacttctgttgtgtgattttttgaggtgggtgactgaattccttctaattgtgaactctacctgagccaaactcttacctttgtcgtcatccttatggcaaccaacactagtcccagaccatgctgaaaaatatctgcctgtttgacttgcactaatgtggcatgtaatttatgtgcttctggaaagaaagtaggatggggtgaaggtaggatatggtaccctgaaagagatgcttgagccttgacattcatctgctgtgttgatttagagctatgcaatgatcaggaaaaataaggacatctctaataggtagaagctcctcatccatggaaggggtctgcaaactatggtccataggccatagccagcctgccccctgtaattgtaaataaagatttattggaacacagtcacactcatttgcatattgactgtggctgctttcatgctacaatgagagttcagtgatgacagcagagattctatgacccaaagaaactaaaatatttattatctggtattttacctgtgaagtttatcaacccttgttccatgaatttgggatattttatatgcttgtttactggagccaggtgcagagagtaggtgaaaattataatgtggttcaccatttcttrttaacaaaaaactgaattttaaacatacagtgtagctgggagtggtggcgggcacccataatcccagctactctggaggctgaagcaggagaatcacttgaacccaggagacggaggttgcagtgagccgagatcatgccattgcattccagcctgggtgacagagcgagaccctgtctcaaaataaaataaaaaagatgagggagtttccaagaggatgagactgagatcctcctagattcattttatagactgytgttctctaccagattctgtgttctgctgctgatggtgatatttgcttaatacttcttatataccaagcacatttataaactcttattctcgtaacaactcttttactgaactgctctttcaaaagaggaaattgaggtatggggtgatgatctaaggatacacagttaaatggtggagctggaatttaaacccagagagcctgactccagagctcactgtggtaagctacctgcaaaaaaaaaaaagatagctcctggtcttgcaggctttcagggtgaatgaaaaaaaaacattgcaaaacaagtcgtatcacaaattaatggaatggaatacaaaaccatcagtgttgtggacagtgtctagggaaggctctctgttacccctgtatgttcagtggaatttgtattacaggaaagccttcagctacgcccttcactggccacttaaaatctcattatagacactcacagagatacaggcatcccagagatcccagctcccagggactacattccaaggacaaatcgtgtagctgaagtctagaaaactatcttcctccgaaaggaacagctgaaaaatagacagtgaatctttactcccagcagaccaatctttaatgagtcagagaagagagacaagtgtgggaggctgtgctgaggttgacattgttcccatgattgcatttgttaagacagtggtcaagataacagtcaggagatcaggcataccatgacttagatgtgtaactttggctaagcctcagtgttctcatgtagaaaatggtaaaagccctagaacccaacagtggaagatattgaccaatatttttggatactttctatcagaatttccttcttagacttaggagataattattctaataaggaagagcccaacgcttagtatagaagttgattatccaagcatctccttctccccgtcttctgggtagcttgagtgtgggtatatacaacctaggctttccctctgccctccagtcagacacaccaacccaagactttgaattggaagctagtagtgattagacttagggatactgtagacaccattttgctgaggatggtgggagtagccacatccataccagcctcctaagtaccagggaaggcatctagcatcaaagctgagctagctatgcacagcaccagctctggatcccctcactaaactagttctgggacctaatcttgggcttggaattgagcttcagagcaygcaagcctggctctccagagagtgttccatacgtaaccaatattctttgaacaaattttgcttgtttgttttgcttaagttatccaaagttggtttttgttgactgtcactcagaatcttgactgaaaattattgccataagataatgtgagatttaaccccatttctagcaagttggatgtgcttgatgcacagatgcacattagctattacttttctctatgtgtgtttgtgtggaatgttgcgggcacaggataccagcaacaaccaccatttatggatacccactaggtgataggttcttcatacgcatctttgttttctgtgaactacgggtcgtctcttgtttccgtatgtgagatctgaggtctcttatgacatcttaacttgcaccaggtcacacagcacacagaggtatgatcctctctccagtctgagtagagaacctggctttttctactctgccactctgcctctccatttgaatgactttcttccttccactgttctttctttgttcttcttttctcttcaccccttcctcttccccctttttcctctcctcctcctcttcttccttcactccttcttctgcctcatattcttctcctttttctccttctcttcctccacctcttctaccttcttgtccttctcctgcttcaatttagaagggctgatgttttctctggcttagtaacaccagcgttagggtgggtgacagatttatggtgacattcccattcacttttcagaagcccacacatccggaagtattcccaaggtgccagtgtgttattatgcaacaccctggggacttcccgttctcaatttcccacccctggtgccctcatcccccagcacataataagttgcttgttaaaatgaacaccacccacatgacctctcaggcaaggcaggcttcatccctttgcaatgtggaagttatcttgtctttttttcccctcttttaaaaatataacatacaccaggcctgaggtttcagtgaaaaaatgtggtatcagtaaaatgataactctccccaacaggcactggctgcaggcattgttcacagcattgggaattctgtctctaaagcattgagtcataaactacagacaggctgctgataaaagctgaaggaggtgggataatagtcaaattagtcagacaaaatgtgaagggtccccaraaggggttatactgtgtaatatatctttagctggtgctggaaatgtgttaccttctgagatggaatctagtgcattacaggagatgcagctgtggagaagccctcatgctctgttttgactttccaccctgtattcttcagcatagttgggtccagttcccagtttagatctagaggcctcctggctgcagcttagcacctcagagcctcagtttcttcctttgtgaaattagggagactggactgaggactctaaagcttcttccctcatctgatactgaggaatctccgatttgtcaaacagctatttaaaggctttaggtttcaaatcctgcctgacgctgatatatagttaagaaaacaaaggaaagggacccccacgtcgtctttcccagacgtggaggcattccctgtgtgtctctttttctccctccctccccactcctcttctctcccctactcctgccattagcatcactctgtgatccctgacacagcatccccagccctgtcctagagccagggccagtaactcaattagcaacccccagccccagctccctcccctcccctgtgagggacatcgaggagaggagaagaatcggtctgcctccccaccagttgctgggaggggcaggggttcaccgagccttgtggcccctctgtcaggctgctctggcctgctctgagccaaggcgagaaaggaaaacaagaagatgaatcgccacgtcttcttggtggaggttccgatgagactttagaacaacagtgactggaaagaaaaacagcatctgctggaggagagggggaagaatgggctctgctgggagttgcatttattattatttttctttctaacaacgtgaaatcataatagatgatccacctctcaccttaaaaaaattaaaattaagaaaacaaaataaaacttctccagactgcatgtattcaatcagacctccctccgtggaaaaagtagtaactttccccagaacacgtttttgaaataaagcttcccttggcttgaaggcaggcctatgaaagaggaaaaagaaagaggaatataggtgggggtcatggtggtagtgattaaggtgacgacgagggtgataatatctcagctaggttggtggcattcttaacactggagtaatgacatagggtatccattgttaagaacacggattctgggtggaaagcctgtccctgacacttagcttgtgtcgcagttttttcaatcataaaatgggttagtaagttcctacttcttagaattattgcaaggaaaaacaagtttatttttgtaaagcatttaaaatggtgacacctgcctgacaagtgttatagatgtgtttgctactgatgctattattgtcataattaatattttattttttattttaattttttattttttgagacagaatctcactctgtcacccagctggggtgcagcagcatgatctggactcactgcaacctccgcctcccaggttcaagtgattctcctacgtcagcctcctgagtagctgggattacaggcgcgtgccaccacacccagctactttttgtagagacagagtttcaccatgtcggacaggctagtctcaaactcctgacctcaggtgatctgcctgccttggcctcccaaagtgctgggattacaggcgtgagccaccgygcctgactgaatatgattaattcagaagttatatccatcttcccagaaaccctatgagataaataatgttatccccgttttgtagaggaaaaaactgtggttcagagagatttagtaacttgcctacagttacacagagacatagcagacgtgagattcacagcatctaggcagagtctacacattttaaccatgaagttattccatttattagatacccagctgtgccagtttttctgctaagaactctttgtaaaaatgatttcattcaccctcccagcaactctgtagagtcaaaataattgcaccattttgctggtcagaaaattgaggcgttgagaggttaagtgaatatccaaagtcatatagccaggtaggtcagagaaggagacttcagagtttgtctgtctgccctaaagcctatgtccaactccagactaactcttgaaatagccagagagtgtttctcttttccactatttctgtttggtgccattgaatcacagcaggaaacaaaagtgaatgcacatgtccttgtgccattttcatgagtcatgaaacaacaattttcagttattatcaccctagaaatgttccatggcataaagctcatacccccaatggagggtcattctgtattttaggctgtattttcatttttaacagatcaccctccattgacagtagccaaatcgttttttttttagcatagaatgtgtttggcacttaataaagttgtcatagcaatgttggagacagaggagcttgagttcaaatgtctattggttgcaattactacatgggtctttttaggcatctctcaatacctctgagtctcggtttcctcttctgaaaaatggacgtaattataacacctatagttttgttaaggaaaagaatgacataacatctatagagtgtttagcacaatgcacagcagttagtggacaatcaaggatgtcagttaacgccacctcttcttccccttcctcattgcctatctcaattgtgactgatgcaaaggcagccaacccatcatcagcaaaaatggtcctgaaccaaatcctgatgctaaattacagtggtgccatttgcaaaatgatcaaacctcctagttctcagtttccccactgtaaaataatgagggaatttgatgagctcccagggagctttcagctccgatttttaggatttaaatcccaggttgttattgttttaaaactggtacattttaaaagaaatcagggcttggggaagagaaaggaattcctttcacccaaagggtcaaagggggtcactgaggggacaaaagagcaggaaaaggaggcgatggggcggaaggctgacgtgcgggcagcaccaaagatctgaagtactcaacagggaggtctgatggatgcattcaaacacccttgagtcagcaccggttaggatcaagcttgccatcctgcctcagaccaaggcttaccacctcctttggaaacccgggaggcctaccccacagagaggcagggctggaatgaaaagaaacagaacggcctctgacgccagaagggaggaattctagcccgcagcccaggtctgcttcctgactctcaggaaggggtcaggctcagggaaccgacttggtgcttgcttgaatgtgaggaatcgagaccaaactttgatgtgtgcctttgaaaggcagccagagtccaaggcaggtgaatctgggtagccaagaacaaggacttcattgtgatatttaaagtgaccagaaattcatctgcacatacatgtgccttgatgtacatctgtgcagttatgactgaggcggactgggagagggtagaggcctctaggctgggtatcagggccttttcttagctcctggctctcagttgtttcttggagtccatgttgggttggaaaagacatttaatattcatgagctgtgatctctacttgaagggagtgccctgagggaaattgaaatattaagcaagtgagggatatagacctaattgtagcctccttttctttttggacagaaaagtaatgtgcctaaaataaaatgatggatgggcagtaaggattgtgtgaaaacctcactgctagagcctgcaggaaaaaatcggctgcttgccccaacatgtgcagtcggacccaggcagaagattctgcaaattggctgctggatgatgtcattcattcatttagttcatattttttgatgcctgctgtatgccaggcactgtgcttgtttcaaagaaaacagcagtgaaaaaggaaggccagggaggttaggaaaatgatacaaataattatttaagtgtcattgtggaaaatggcactaaatggaaatacttggaagtatataaccaaagggcctcctttacattgagggggtcaaggagatctccttgaagatttgacatttaagctgagacttgagggttgagtaggatgtggactcattagggagatatggaacaggtaactgagcaaggattgcaagaagttaagactattcaattcccaaggcagagaagaacttttgaagagggaaaaggaagtcagcattgctggactgtagtgaacaaaggagggatgaggctgaagtctagcagtctctgatttctcaggcccttgaggactrtggtgaagctgctatttacggcatgaaggaaggagaagttgactcaagcatataccttctacactctctaccaagccctgccctgggcataatagccatgtgcatgcttgcacagaccaggtgtcagtaaaccaccacccatggccaacccagcctgctgcctgttttcatagacaaagttttactgaaacacaactatgctcctttgtttacatatttgccactacaaaggtggagttgagtcattccaacagaaatcttgtatggaccacaaagccaaaatatttaccatctggtcctttactgaaaagttgttgactgctggcagaggtggatgagtacacagttggcctgtcatatcctcagatcctacatcctcagattcaaccaatctcagatacaaaatatttgaaactaactggctaaataaataacactacgacaatttaaaaacagcacaaatagaaaaaacaataaagtatttccaatgtattaagttttatgagtaatctagagctgatttaaagtacatggtagggtgtgcataggtcatatgcaaatactaagggactttatataagggtcttgaatatcttcagatttttgtatccaagggggtccagagaccaatgcttcgaagatacctagagatgactgtgtaagcgggtaaaagtatagccagttgggcagaataagccagatgagagagacagcgcgaggagttagacaatcatttcatccatctccctcctgagcctataccagcatagctataatttcactgactcctcatgtattttacttccacatctgtgtcccttacccttaagggaagaagccttgccatctaccctcgtgtcccaacatccagctcgagccaatcattgagacactgaagcaaatgacactctgaggctaaaaagggtggccagaggaacccaaacagatgaccttccaaacggtttaggcagcatccaggatcctcccctgaccagtagaagggactgtattgatatttatggagaacctgctgcagtagctcatttcaaacccacagcacccctggctaccaggtattgttaacaccacattccaggtgacacaacagagcccccaaatgtttaagtgacttttgagaatgtggcctccattcaataaatatttactgagctgggaaaccacccaccagacaagcaaatcttcctgagtgctgcatcttatgccaggccaactgcctcacaccccacttaaccatcctcttgattttcccaaggctacgggaaggtaggggccattatcccccactttacacgaggagaagttcaggctcaagaagatgaaatggcttattcaaagcgggtgcttattaagtgacagagttgagatttgaaccaagatctgcccaacttcaaaactaaagtcaccagatgacctcctccaaaatatgaaacctttagaacaagaaggagccagtgagaaatatacagtcatccctcagtatccttgggcgatttctgccaggacctctgtgaacaccaaaatctgtggctgctcaattccctgatataaaatggagtagtatttgcatgtaacctatgcacaccttcctatatacttcaaatcatctctagattacttctaatacctaatacaatgtaaatgctacataaatagttgttatactgtaatgtttagggaataagracaagaaaaaatgtctatacatgtttagtacagatagaattttattttgcatctcttgaattcacagatggagaacccatgaatatggagggccaactgcatagactgcatatatttccaccctttttccatctcaccatctcagacaaaagtcataatagtatacataactcaaattattaatttaattaaattaattggataaaattcactcaagctttttctctattaattccactggttaatcacattaatgctatgaggtagttttaacattatacaggcattataagtaaggaaatggaggcacagagatgttacgttcccagtaagggattctagccctggaagtctctggctcttaagccctcaggcttaactactaatttatgctacatctccatcattaaggttatctaataaagtgtgtactctcaagagctgaacagcctagcagcaaacagataatgagaaggggaaacaatgcaggaagctaaagaaatcttcacataacaaaaggatcccagggtctttttaagaaacactgtctgaagtgtttgtttacagatcattaaatacttaacagaggaagaaactaaaaaccactgactttctctaagccaatactgattaagtaccaaagagatgttaacataaagcaaataagaaattataataattattaaaggactgagtttttttcattttatcttactggacagaaagataaaatagcccaggtccagtgcctgtcactctgccctcatgcacacggttgcttttctctctcctccaggcagcagccatggtggtcctgcaatcagcctaaaatgcatgtgaccaggctcacactgrttattgtctatattaagcacctgctgcatacaaagttctgtgcaatgcagggttaagcagcagaaacctttgttagagggctgcagaagacagtggtcattaaagatatgaagggattggcattagaggycccctgggagcagtggaaagcctctggtgcaggggttggtgagcctgggaaagatttctggacagtgggactcagataagaccaggtttgacactctgccactataaagatccagacagagggtttttctctatacagtgagtgcaccagtcctaaaggaaactactccagggaagtcacagggggtgagtgggcagttctcatcccatagcaagcagtagtttctgggcagaggcataacatgataggagcagtattttaaaaaagatcaacctccctgaatgggatgctcttcaagggccaacaaaatactcttggcaaactgacccaaagagaaatcagggtgattttagctttcaacagcagtcagaaacccagcccaaattatccgtaagtttaaatttaactatcagccgccattggcaggactctgaaaggtcctggctggagttggttcctcagtttaggagtccaaaaccacatgtatagcttgagttcagcctcattaccaaggaagggtctccacaagagtctgaaatcccttttccatttgtcccgtgtgcattttgccaagagaacttctaaagggacagggagggaggaaaagctgattgaccagccccgaagcacaaggaccacttgtctgcctcagggttcatcccccaaatacctttttccacctgagaagtaggagtgatattcctgacttcatatgattgttatgatatattgttttattaatttataaacttattcattcatcacataggcttttatttattgagcacctcttatgtgccaggttcatgctagacaccaaggatgcctgtgtttgtgacagttcctgtcttccagaaagtgatcaacaaatattgattattatggctaacaaaaataataatctagttcttactcacaagtagagagtgacctgtccccggaagagattgagcagaaatttgagaatcattctttagggaagtcatgcatgagattctattaaatagcatgttcaaacagacatatttcaatatttttctcttttgtcttatctggctctttcttgaaattcagaactcctggtacctgtgaagtgttagcctcttctgtttttcttaacttttctgaccatccctccacagaccttctttcacctactctttaagtatcagcagtctccaatgttccataataggcacacttctcattctccattctctccttgtatgactccaaaatctctatctttagtctgggcctttttttttttttttttttttttgacccatgaacttgtatatctaattgctctactttgacgccccaagggaactcacattcgacacatcttacacaaagcttgccatctttctttccagacctgctgcaagtgtttttcctaatctcaactggtggcgccagtagccaaccagacatttaaacagaagcttgggaaacatccataactcttccctctctgccatttcccacatccaaataattgccattcttcccattttactttgaaaacgttatcttgtctgcgtccaaatcagtctctctcgccccatgatcattactctacctgaggccctcttcagctcctgattaggcttttataagagaaagcttgtaaaatgaacatgttgcttgttcatttttttgcttgccccaatctacctgcccataggtgagagcaagtttcctaaagtgcagacaccttttgttgctctccaattgagagtgtcagatggctccatgttgcccttgagataaatttaaattccttactgtgtcatttaagaccttgcgtgatctgagcccaggatttgcttttcttttctttttcttttttctttctttttctttttcttttctttctttcttttttttttttttttttttgacagattctcactttgttgccaggccagagtgcagtggcactgtctgggctcactgcaacctccacctcctgggttcaagtgattctcctgcctcagcctcccaagtagctgggactacaggcacataccaccacacccagctaatttttgtatttttgtagacatggggtctcaccatgttggctaggatggtctcgatctcttgaccttgtgtcctgcccacctcggccaggatttgcattttatactccaataccatcttgtgctttatacctcctactatattgctggcctcatctcatttgctcacagtgtccccctgctggaatgtgctcctcaccacccgttcctcctctgagagatacagcccaggtgttgcctcctaagggaaaccttcttaaatctgggttagattggattgggggtccctcctctgtgctcccacagtatcttgtacctcatgagggtcagaatcctgtgccgtcatcatttacatatctcccctctcactaggacctgagttcttggagcactgagacctgctttaattcatctgatttcccaagagttagtccagggactgacaaataatttgcagttcagtaaatatagaataaatgagtaaaagaaggatgtatttcttaagagacagttttatttttcaggcaagaaagtgtagttgagctttgctggtctttagagtcagacaatcctgtttgaataggagactttcccccttagctgtcatctcgggcaggttatcttgggtcaggtggcttggggtggtggtttcatgctcagacccctgaactgggctgcttgtatccaaatcctagttcccccacaaaaggggtgggggcttctttaaaatgttaatgttactatatcgatacaccaagaggtagaaagtatgctatcttagccagcagtacttttttgaggcttcttttactaagtagagacgggctcaaatgctgcctttccttctctatctctatactgacagaggtcattactctttggtaaggtccaaaggctttagaattttagaagaatgggtgggtggaaccagtgattttggtggtatttggatcaccccataagactctcggatggccccaaattgagctgctttttaataccaaatctcagtctgcggcttgcttccatttggggagagagcctaattaactcgtagctggaaagaactgcaggtctgccaccccccaggcagagaattcaaaaggaagtggatagctgtgtaaataacactgctttaaggggcatttaagccaatgctctttgttaaggaaattgatggctttgtaagtactgcgtctgaagggagtacttgagctgaaggtccccatctcgcctcgtaaatttcctaatggactgtgggcctgcaggctgggcccagcgtgttcaatcacttgccaacaaaaactcggatttcactctaaaaaaattaaaaacgtttaaccaaaacataagttattgagcctgtgcagtttaactgtggcacaaggtagcagagacagattacttcctttaaggaaagggaaactcctcatcttttactttaaaaaatttgttttttaaatgctggatgtggtgctacgtgctttctcaacagcttctcatttttttgtcctcataacagttgggaaggtagtcattattttgccaatttgccaaagaggaaacggactcagggctaaagtgtgctggtcattgacaccagctaattagtgaagagccaggttgtgatcacagctccatcaggcccctgagcccccaagtagtgccaaatcatagggcatccgagagagaatcagatcagcccatctcatcagattctcctgaatatccacatccattcaaaatagattaactggacagcatgggaatgacttaccctcttgaaacctcaatttcattgtctgtaaaatggggataataataggaccaaacacggggctcttctagatttgaatgccttatgtacttgaaacatttagcacaatgcccagcatggagaaagtcatccagttattcatttcacaaatacgctaagtacaattttaacyggggaagcggatgatggtataggaagacctagtgagggtccattagcccttctgggggtgggtttccaggcaggtttttgagaggttaaactgtgaataaaggacaaatggggactagtcacagaaaaggcagctctggggatttgaagaaagcttctgcaaacgtggggaggtgagagggaacatggtccactcagggcaacgacaatttgtgtctggagcttagactagagtgcgttcgagaagagagaagcctgcagaggcaggcaaggaccagagtacaccttgtcaatcatcatcaagctcctgttgggaaaagttgaatgaataactcagtatcttctrgggcaaccactttcaattttagaccaactgtactttgttagaagagttttcyattgtgtcctccctgagccttcttttcttcaggttaagcatcttcatacctacatgattattgctcagtggttggtgcctatccagggtcctattctttgaccatatcctaccacatcagtggcccagaattggcctcttcagccatgactggtccagctaggactggagacaacttctctggcctctagcttggaatctatagccaatgactcaatctgcagtctcatgcttttgtttgggcaaacacatccttcatttggcggaatctgacttcagagtgactgcttcttggaacttttcgtgaacatgaatagttatgatgactcttatcatccctgatcaaaaagggcagtggttttgattgatattttcaaatgttcccagttaactcttaagatttaggaccaggccaggcgcgatggcttacacctataatcccagcactctgggaggctgaaatgggcggatcacgaggtcaggagtttaagacaagcctgacaaacatggtgaaaccctgcctctactaaaaatacaaaaattagccgagtgtagtggtccgtgcctgtaatcccagctacttgggaggctgaggcaagagaatcgcttgaacccgagaggcagaggttgcagtgagccaagattgcgccaccgcactcaagcccaggtgacagagcgcactcaagcccaggtgtcaaaaaaagaaaaagagaaaagatttaggaccaatttatttctgtctccctccctccctccctccctccctcccttccttccttccttgctccctccctccctccctgcctccctttcttccttctctcactgctttccctcttcttactgagagatgagaaagacatatacacaccttgttaaagaagaaaattacagctaagcaatacaaatcagaacatatagatttaagttattatagtatttttattctaagggctgaagagtaacccattcattacataagaaaaagaaaacttacccaagagcaatcytgtgcactgtctctcttctgttctgtagaggactgcagtgtgtctcaccagcttggagatagaagacactgtggcttgaatggctcatctttttagacttatcgaaaccatatagcaggaggatggtctttgaggtgaaccaaaccagtcagagttcagggtgggagggatccattttaacactctggtttctgcatgggagccctgccaagaacatagcatgctgcggtcaccttagtcacaaccagctatgccagattggggtaactggcttggttttcatgtggtgcctgactcatcctcgagtccttggcccactggtagacatagcatccacttgtccaagcttctttctttgctggactcttatgcatgccctatcagaatgacgggctgcttgttttactggattgcagaatagatatgcatatacatatatatatatatatatatatatatatatatatatatagcatatatatatagcatatatgtagcatatatatagcatatgcatatacatatatatatatatatatatagcatatatatatagcatatatgtagcatatatatatagcatatatatagcatataaatagcatatatatagcatatatatggcatatatatgccatatatatagcatatatatggcatatatatggcatatatatagcatatatatagcatatgtatatatagctatatatatatagcatatatatagcatatatatatatagactttcatttgcatgcattgttttacttaatgcttacaaacatgcatttctcacagagcaatttttatttgacattgaatattcccaatatttgtataataagccttaatcagccagtcagaacccttgacctctaacawttatgcagcattcagtgagttacttaatctttctaagtttcagttgccactttatacagagaagcacaggaattagaatcatatagaatgtctagagaaccttgcagtgttaaaacgttcattcgttcagcaaatatttctgattatcttctatgtactagtatctgactgcaacaatgcacacaacagcctatgtttctgctctcaaggagttgccattctgttttagagagaatacaattatcaagcaaacatttgaagaagtgagatcatgctatgaagggaataaaatagacyagtggtatagacactctagtgaaggtgaaaactatttkttgatagtgtgtttagaaaagtcctcactgagaaggtaatggttgagctaagacctaaacaaaaaattagaaaagccatttgataaytggggagatgaggtctggattgtatctgcaaaagtaaaatgtgaaaacaacacagcttatagtttttatgtttgagtagtttttagttttcacagcattattttactttatctttacacccacttttgaaaatgggtaggaaaataatgctgtcattttttttaataagcaaaaagaatcagatgcagaatgatgatgtatgttactggtaccatgaaagtaagttagcaacagagttgaggcacacactttaccttctggccccttattccatctgcttttcgttatagttctatgcatgtttttcagaatgggttcatcatctacacgcttctcgatcttcattttgctgatcatgtttctccatcttttttttttttcatgtttcccctcttaactgaataactgatttagtgatcaaagggcaaaatgtcaagaaccaaatatatcttagagtgacacagctaaaagggatcacaaagctacttgatttaactcttattctatacaaggggaaactgcagcccagagagggaaagtgacttgtccaaagtcatagggttgatcagggcatctattctaatctccagttcccttgactccctgaccattactgtagcaggctgcagagtttgagaaagtgtctcatattttctctcttttctttctctctctctctttctttcttccttcctttctctctctcttttttttaatatggagatacaatcacactaaaactgctgaaactccctttgtagtttgccatcttttattaccctctttctttgccactttttgcacactctctgcatatccatgttttggatttttttttccrtttattagcttatattatccaggccaaatttcatttcattatttcctgcccatacttttatagacctttgggtcctaggtattgctcttccttctgtttgtggttagaatgccagcctatctcttggctgctatataattcatgtgacactggattytaccgcctctttcatatcttgagatatcattgaaacccaaaagagaactggctgaaagtcatttagggctttgaacattctgctctgttggctgcattgtcatttataaggattactatctttgcttacaatctttttaagccattcaaattactatactaaatttaaggtgatgtaaatgcatcttcaagttccaattcataagactgtcaaatctctttattaaattttactctaatatgtgctacctttcctatccagwtattccatttcttttcaaattcagttaggatagaaaataaaacaatatataagacagatggtgaggcatgatgtctcataggaaaaaaaatatattgtgggacaatttgtgtagaattggattttccccctaatatgtgcttggatttatgctctgacctctttataattaatattttcataaaaatttttacataatactatctgctaaagcagattgaaatcaggtttgggacatcttcagaatcattgataacagagattctaaaactccaaaataactttgttaattcatcatttactgagtatctgctatgagattgacactatcctaagtattcgggatattaattaaagtaagacaagggccagaaatatctgaaaattcaagagctgtacaaaatcattcatttattcacttattcatgtatttttaaacatgacataatatagccaggtagttttcttgaccctaatggaaaagatgcactttgaaacatgcttctattaaacttgtgttggttgtatgggagcagggaacaataataaataaatattttattttttattttatttattttaaataaaataaatatttaaaatagtgaatactacagtaaaggaaataaaacaatatggtatgctactttgcagtggggatggaggattagaatgtgaattaactgcttgttacttgaatatttgaaatgactgctaaataatgaagaggtcatgagaaaagccaagaaagagatattccagaaaatgtgaacatcaagttcaggttcttggatgcttacttaaggaatagatacttgttgtgtcgatagatgtctgtctggatgaatgaatgaatgcatgaatgaatggaaggtagtgagcaaggaggacagtaacagaagatggagggataaagcaggggcttgtaggcctggatacagactttgaactcttccacatgagatgttaagccattgaggagttttagatgaggggcatggcatggcgtagtttacgtttttagaagagcactatagctgttctgaaggagggatagttgggaaacaaatggttgagaaaagagaagcagataggctggttaagtgagaattgcagcagtgatgttggcttgaactagggtggtaatgatagaacaaattagatctattttaaatatcccagggaaaaggagcctataaggtatactgatggactttgtgtggtgttaaagggtgagctgaaaaaaagtaggacagatgactgggaaggttttggtttggtcattgttaagtgatggtgttgtcatttactaaggtggagaaaaagggaatgtggggagaaatcagtatttttgttttagatatgttttttgatgtcttttgatgattttgtgatgcctttaaataggcagatatttagtagagatataattttaggcagttgggactcagagaagaggtcatatctaaggctataaatgtttcagtgattggcacatagaggttttaaaatttttatttagaaactgagacaggatgagaaactgtagataaaaaagaaaaaggggtccccatctaaccctgaagtctggcagcattccatgtagagttagggaaggagaagccctcaaatgagtctgtgggggaggatcccagacaactaggatgacatgatgtcatggaagtcaagagagggaggactgcaagaagacaggagggggctacttctttatatgcttcaaggcagtctagcaagatggggattttgacatcatgctcagctttagcaactttgaggttgatgacgacgttaatgagattgattttggtggagtggtgagtatagaagctagactggagagaaccgataggtgaagtgcaggagacaaagtgaataacactagtttagataacgcaataaattttactgtgaatcatagaaagagagatgtgggataggagaaatagtatttaggagacgtataacagaatgaaaggaggtttgcgtttttattaatttaaaaactttgaatttttcaagaatttttacatttttaaatctttagatgggctatattctattttgctgatttgggagactaatgatgtaggaaatagagggaaatggtttgtaccaaacaagtagtgatgcagaaaagtgagagatgtcatggagctgaagttgctagaactgaatcttaatggaagactcataggcaggaccagcctttcaggctaaggaagtaagggcagatgctctgagatgtgagttctgggaaagaactggatgcatttgacggtggagatgtggttggaactaagaataaataggaaagttggagctagattacaaaaagacttgaaagctagttggggaagttaaaattttgtaggagtctatgaagtatttcaaacaggctgggcacggtggctcatgcctgtaatcccagcattttgggaggtcaaggcaggcggatcacctgaggtcgggagttcgagaccagcctgaccaatgtggagaaaccccgtctctattcaaaatacaaaaaattcgccggcttggtggcgcattcctgtaatcccagctactcaggaggctgaggcaggagaatcacttgaacccacggaggttgcagtgagccaagattgcaccattgcacttcagcctgggcaacaagagcaaaactctgtctcaaaataaataaataaataaataaagtatttcaaacatgaaaatattcatattttagataaatcattcatagattcataagctgctttgtgagaagggattgaggtgaggaagatgcaaagccagttttgagtgtgtaagggctaagtagatagaatatgaggctgtgctacaggtgccttccttgatgggcctgagtgtagagttagtgtgataatgtgattacttccagggatgctcttcttttccagtgccttcagtttgttggaggatgcttgattctcacagtgaaacacagggaggaatttctggcccatgtgggtatgtggccaacctttgaaggaactggaaaccaacttaagctcctcagattcaggtctccttcagtagacctaatcagcatctgaagcttgttagcagattcatggttccttaggagccctcactaccctgtcttttgtactctgggcaggctgatctggttgaggaggttaagaagaaaccctggtttgaatagaattaaatgaggtcagcaatgtgggtttgacacgaagcctttgaaagataggctatataaagtcaagatatttctgtcccagaggaaacatatgccaatatatagccacctcccagccccacccaagcttcccctttgtaaaccttcagcaggtaagcactcctgctccccctgttccaagaaactaacgtttaagtacaaagatcacgctttgttgtgtgtgggggtgtttctttttgttgctgtttggaagaattgtgatgtggcataaagactgttgttattgaacccatctctaaataaacagctaaacttaaaatatgctactttttttctggcctttaaagatctttttgaaaagtaatcgttggactaaaagagaatatcataatgccaatcactgttttattagctagaaatagaaatagatgctaatttctcaaaagctgtcctatctttatttgcaagaaatttagaaagacaggtgaatccactcatcgtttggaaggaggttcatttcagaagagtgcacattcaaaatctttgctttctccttgagctctaaattagtgactaagaactctcatctcctcatctacaggtagttttgtgtatgtttggttttctttttggctcatcaatgggctggaagattagtaacctcaatagcttcccagactagttatatttagccaataccagtgaatgttacaaaaagtgaaatcagagatttccaaaagtaatattgagacttacttaagggtaatcaactattttgctcccagaattatatattgaaaagtgggccgggcatggtggctcacacctgtaatcccagcactttgggaggctgaacggggggtggatcacctgaggttaagagttcgagaccagcctgaccaacatggtgaaaccccgtttctactaaaaatacaaaaattagccggatgtggtggcgggtgcctgtaatcccagctactcaggaggctgaggcaggagaattgctagaacccaagaggaagaggttgcagtgagccaagatcgcaccattgcattccagcctgggcaacagagcgagactcggtctcaaaaaaaaaaaaaaaaaagaaaagaaaagaaaaatttcaaagtctcctcatttctgaaggataatttcgatttatttaacatagtattgcaatcttttttaaatctagcttcagatcagtttcttactgtattagttccaggatttactgcattcccttactcaagtattggtcaaagtttatcctttactcagacacctctctttacatgctcaaactatttataccctctaagatgtttctcccaaatcattttgtcaaggaagccttctctcattttcccaagaagtattgataggaggagggcctgtcctgattcattaacgtatttccagcaccagcacaacaagaagcagatgttagtatattgattaaatgaatgtatagacttctccagttctcatctactgattagaagatattttagctggggattgcaatagccctcactcctaaaatctccagaaagctttggtagctcttatctgttgctcattcattgctgaaataatcaaaaatgaattactgggttcttagtgttagctgggcatctcagaaatgtttgagaagcaatcccttggggtttaattttgaaaactgcaatcccaaggtttgaggaaattttatagtgaagctgataaatcttttagaaaaagtgtgacataccctataagaaggtgcctctgttttgatgaaatctggtttgtagtactatcatggtatggtcagtaatagcattacaaataagtacacaagcacctagttagtttagtctatgtataatctggtaataaatgaactcaaagataaatccgttgttacctttcatttgttgtttatctagtcatatattcctcaatcactggtttggtgtcccctttactctgagcactgttatgggttggaaatactaccgtgaaggactccacaattctgttcgcagagatcttgtctgcctgataaggaaacagacccacagacagacagtgaggaaactgtgatggaagaaatctaggaactgtgataacacaggaatgacactcagctagggtggggtcaggaaaaagggatgaggaatagagaagacttgcaaaggagatgctctagatgaaccttgaagaaccagtgggagttagcaaagtgaaaaatggaaagcacatttcaggcagagaaaaacaacctttgtaagggtgtggagaaatgaaacggaattgttcgtgtggaatgtgcatgaagaggacagtttgtggatggtcttgtatgccaagctaaggaaaatgatgttttttaaaattatttttatgtgtttattttttttttgagacagagtcttgctctgtcacccaggctggagtgcagtggcgtgatctcagctcactgcaacctccacctcccatgttcaactgattctcctgcctcagcctcctgtgtagctgggattacaggcatacaccaccatgcctggctaatttttgtattttttgtagacacagggtttcaccatgttagccaggctggtcttgaactcctgacctcggatgatctgcctgcctcaacctcccaaagtgctgggattacaggcatgagccaccatgtctggcagaaaatgaccttctataagtagtggggatctatcaaaggaggggcatggtaagatttgtatgtcaggtagaagacttatagccaaaataccttaaattatcccactatcctagagaatacacattatctcaggccatgtttgaagaacacattgacttcagttagcttttacagtaaccgataacttatgactatctgttcaacgttttgaaactgatgagagtcaatgtgaaggcaagtttccttgtgaaaattatccctaatatcttgtactgagaagacacgaataatttaatttcttcctcccttctccagctctgacctctttaacctctttaggtatttctgtcacttattcacctgagtgattctagtgacatcataaattcccaaagtttctaattcagctaagttaattattgtccaccaattgtgttgaaatcattccaatgtaagtcaatatattcttttctttaggttgttacttttttcttttgtttgtttacttgcttccttggcatttatattgaaaatagctcatgcatcctctttaatcatgtctatccttcaagataccttagggtctagggctgggtagagaaaagtagaatctctaattaagaagacttcttctccaactccaacctcattatcatcattgttaagaatagaccctgtgtctttaagaccagtattattttcccatctcagtctgttatgctatttgatcatcctcagaaccttgttgagaaagtctaaaatgtaattttgttttcattttatatatggggaaactgaggcatagggaggtgaaataccatgtccaagattaaccaataatcagagatagatcaagagcttgaatccaggatttctgacttcaaggataagaactcttaacaatagctctaacctgagcctttgcttcaaggtaaactaatatcattttcctaagatttggttttccaagctttcaaatgggaataacgatctctgtgcatcttaagtagtgtcctgcagacatgcctcaggaactcagggacatggcatttcaccttgatgctccagataaatgaaaataagtcagctggtggcagtatcaactatgtctgtccacttacaccaagtccatctgcctcgggctcttgaagctgaactcatttcttccaaaaggaaaagaaagtttctggcatatgaaatctcaactggagaagacagactttgctaatggcacctacccacgtcaagtctcctagctggatagaacagatttctaaatgtgtcaccacatgaaagggaatgaatctgaagtgaggaattccctgatatgaggggaagatggcgtgggatggagaaatcagaatgcccagtgcaatcccactatcagctagtcaccacctggcttacagctccatttccttctccctaagacatagtctaaagaaaatagtcaaagggtacagagtttaaactgtatttggttgagagtatatacatcggggatgccagattttggtcattcgttcattcaacaaatatttattgaaagtgtattatgttttcaggatgtgtatgtgtataaaagtgtgtatgtgtgcacatgaatgtgtatgtctgtgtataattttcttagtatccctcacagtgaaatttactgtattattatcaatgctacctagctactacacggaagttatttgaccttggtattgacttcagactcttttcactacaacctgctcagcatctagcagaaagtatttaaggagcaccaagtaaattgatgtaatgaaaacaagaccagtttgttttagtgttttgttgttgctgtctttgttttttgcggccgcacatttgtattccattcctcactctgttctcttctgtgcttggggcagagggagtagagagggagagagaattccccagacacgggctggcagatgtagctgaagggcccccgggacactaatagcaacagaaactgaatagctgtgtccaaggatgttattttaaaaagagactcacaatagctttgtcagcagaatcttggagaagaaactgcatcttctgtctctctttctctctctctcccttgctttctttttaactccatcttatttttctgtcttttaactcttcctctacgtatctatatatcatctattacttatcgacctgcctgtatacctgtttacctacctgtgtctatttctacctttcctccattctcaggttctgctgattcctagcagacaaatttattgtggtctttaacataatcaggaagaaattagcctttagaagaactaaaatctaaccccmatttctgtcattccgagaggttttttgctaaggaaattaagtcactttagagactagatcttacccttacagagaacataatcttaccctatttttctttacattggaggagaagaaagtgataccaagaattaggcacccctatgatcttatttccaagaggttgttttcgtcattctgtagctrtggcatgtagggagaagatttctctgctaggtgtaaaaaggccagtcttctacttcttgctctgctaccacctgtctctgtgacctggaagcagatggcttcttcctcaagctcacagttttccattagataaaatggatgaaggggccagcattatacccacaatcatctgaaatcactgcaacaacgctgggtaaatatcattacctccattttttttttttttcagatgaggaaaatgaagttcagagaggttaggttattttatttatgtcctctttgtagtgcttataggaagcagaattcagatttgtacctacttctgcctgatgtcaaaacccttgctcttttcagttctctgtattgggtttctgaagagtaaagtctggatttatggctggtcactcttggattgggcctaggttatacgatatgtagagtggccacattcacatgaggttggagctactgagaagtactgagcctgtattctttctatattgaactgccatgaatgctactggtcacttataatgaattgatttattctgtttcttttgctcattctttctttcttttctctttctgtttttcktttgttttgttttgttttgtttttttgtttttttcagacagggtcttgctctgtcacccaggctggagtgcagtggtgtgatcactactcactgcagctctgacctactgggctcaataaatcctcccacctcagcctcatgagtagctgggactacagatgtgcaccactgtgcccagctaacttttgtatgttttggagagacagggtctcatcatgttgctcaggctcatctgattgctcaagcaatctgcctgccttggctctccccaaagtgctgggattacaggcatgagccactgtgcccggccctatttgggctcttttgatagtatttcactgggtaaactgttggcagaaataaacaagggattttgcagcttggaagaagttcagcattctggtgcccctgaatccaatgactcttcttttcagatacttagcatcatagaaatctgtcttgtttctccttggcaggggctctttctagctaggggaaagttgcttgaatgtgtttcaagtgagcactgatttcacaagctgatttaattcctccacttagaagcaaatcaacccattaaaagaagagtatttttttttctctcgatgattattctaggatgtacaaagcacatttatgttcatttcctattagagttctatggttatcctgagaggttttcctggttgggactataatttctacattacagactggggacagggggaagaggccaagaagtaagtgaagccagttgtgcaaagatacatagctaatgtaagggacagaaaccaaacccttgtctttggccctaaattcagtgccctctccagagctccactctattattttgtggaagaatgttctaaatcaagcagaagccttagggtgaccatatatcctgatttgcctgagaaattcagattttcccaggatatgttccttttgtctggacataatttttaatagcaccactatcattttcaaagtgctctggtttggatgataaattatatagtaaccctaagacactggctagcaactatatttcaaggagctcagaatctttcaaaagtcctgcaacatgtagacttaatagcagcacagtgtgataagtgttaagatagaaatctttataaaataggcacccacacaggaggtggtatttagctttgcctagaaaagttgggaaaatagcacagaagagctgatgctagaattagtaaaaaggtggacaaggtgatctcttttggttggccacattgaggtttttccttgtattgttctgtgttgaaatatcaagaaacatgcataggtcacacctacttagaaggcatcctactgctagctttgtgcttctgttatccttgtccttgcagctaagtgagaatcattgcagccggctgcagctttaaatcattccaaacagaagcacttgctgtggtctagatgacatgggagcttgagaattcacttggtctttaactaaaactcctagggtatccgacaagcccttagaagcctatagcattagacaggaagggttcttggtgtctcaatagtgtaacctctttctctgctctgatggttgagcccagtgtggcaaggagacttattcaaattaacagagcaatttggtttcagagctggaattgaagccaatgtcccttgtaaatcagttcatgttttaaagcaaaactgaaatcctctttggagttaaacaacccccagtttgcctctgtgaaattcytttgtgtcaaataatgcactcagaacttggaaagtgaatgcctgagttggagacccagatcaggtattaacacactgtgtgatcttgggcaagttattaaagatgtatggaatctcagtttcctcatctggaagaataatatcttccacatgaagtttttatgaggaatatttygaataatgaaggtgaaagtgtttgtgaactttttattacagtatagacacacaacacaaggtctaccttctttatatattttaaatgtaaagtacaatattgttaactataagcacactattttacagcagattcctataactttttcatgttgcacaattgaaaccacatactcactgaaaagcaactctccatttcctcctcccccgagatcctggaaaccaccattttactttctacttctatgagcttccctactttacatgccatctataagtcgaatcatgcagtatttgtctttctgtgactggattatttcccttaacatggtggcctccacgtttcctataacatggttatctccttgaacatggttcatccatgttgttgcagatgacagaatttccttctttttttttcaagactgagtaatagtccatcgtgactaatgtgatgggcttgacagtaccaatggttttggtggtctgactctgcagctgctgatgattgctgwggccaaagaacaaatatttatttattctctccctttctatgtcaatcttttgcagatgaaccyagccggtgctatttccatgatggtgatggggtatgtgaggagtttgaacaaaaaaccagcattaaggactgtggtgtctacacgccccagggattcctggatcagtgggcatccaatgcttcagtatctcatcaagaccagcaatgcccaggctgggtcatcatcggacagccagcagcatcccaggtaagatcctaaccatgtgtggcatttcctgcagacattcaaagtctccgctatgccccacaaggctactcacctctaaggcagtgtcattggctatagccacttgagcatatctttattaaatgtacygttagggcttcatgaataccatttgtaaaagattagatctggaattgttagggcagggaacattgtatgatagggtaatgactgtcctcctatttccttgcctgtaataactaatatttggagaaagaactccattttgcatatatcatgtatttcaatgaggtaagaatgaatttatattggaagtcccactttttagggggcgccaagctgtgtactacttgaattaacagtaattatacagtaatttgctatgtggccttagactagttctcccacctctctgggccctatttttcgactcatccttaaaataaagagtagttgagcttgttgatctccaagggccttcccaattctaagaagctgtgactcatgcctcagtcccctaatgcactatttatgtgccacagttcttccccaagggactgacagcttagtccagggagtgagagttttggggccactagtgcttgtatgattctagagatggtcatgctgtcccgagagccccctttccaattatcctaccaaggaagcacctgccttccccgagactcaaatttcccagagacacgactcagtgcttctggctgcctggcctagtggcctttcagagaccagcctgcctcctggccttgcagatgagctgctattcccaggcattcctttccaatattgctttcttgatttaggtttagtcgggtagccctggcttctagatgaaagaaagatatgaccttcctctggggtcaagtgaagaatcactgggtgaggtacagaataggactacctcatttttagttgttgcctgtatttgattatttcttcattcactttttgtttatgtttacatcactaaagcctttattcatttgcatttatttttgaatgccctcaggagagtggaaacaaatggtaacatggcatttcctgatgcttaacaatgtatagtgccagcctgctgaatgaatgaatgaatgaatgagtgcacagatagatgaatggctagggttcatcctccccctgtgccacgtctgtacttggtggaatcatctgtgtggttgcatttatcatactgaactctgaagtatctatttgtctgtctggctcccccattaggctgctggttctttgagaacaagtttcagtttattcatctttgtcctctcatgttcaagcaaaggctagataggtgcccagcaaatgtgtgtttaattgactgtagatacacacacatacacatacatacatcccattgccacatgcaaatgaacgacactgacagaaaacactcaygcattgcctctctatcacatagaatgtcctgcttcagaaacaacagtgctggggccagcaagagaacaaggaatccaaattcaacactagcatccagttcttagaaatgttttaaaaacaaccttcaaacaagagaattattaacacactcagaacctcccatgaggaagagttgaggtagcagctgtgcttaaaaatcacccaaatgttattgcgactaatgtgagaaaaggagagaaagaattttccagtcttagcatttgaaaagaagcttcatggggcaattattccaatcttgtaagggggggctgtcaggaattactggtgattatctcttcctaaacaaaaatccaatttaaaaaatcattataaatactagctcttcgatctacaaagaggagatgaggaaacaaaatcatcctattgaattattcattgtaaccaattttattttaatgaaatcgactaggttccattactctgggcttggacataatctttgttacaaggagatttcagctgtaactaaatttgccataatgagatcagctcactggagaatacagggtcggggagggaatatgtgtgcaggctgggtgcagggccaggaagagggcagcagaacaaaagtctcctgaattcctcatctgaaagcaagtacctagaagtcattcacaaacacacacacacacacaccctaccaccaccacacacagaggcacaggcacacgcatacacaagtacgtgggcacacagacacacacacacacacacacacacacacacacacacacacacggagtctgcataattagaggtaaaggctattcctgaagtgtaaacgtaccttccttccaacaacagagaatgaggaggaagtataattgtgctcttcattaccttgtacagtgattagaagagattggtagttaattttcaccctgtcagggcttccagtgaagatgttgatagcttgagaggaggagctgggaggctcttaraagttgggcttaggaagaagatgggaattgtatcatgtgcttctcactttccccccagatgctcatactctccctcttctctctctctctctcacacacacacacacacatacatacacaaatttacacaccaaaaggccctgtaggagcatgggagtaccaaagcagatagaagagaatagcaggaaagaaatagtagttatcaaggtccaccaggcactggacacatgtatgcacattacagccaatccccttgtcattcttcaaggtaggaattgttgtctaccttggagaaactgaggaacacagtggcttcactataagttacatggtccataagggaagaatctaggattagaagaatctcatggaagatgaatgacagtgggtccttgggaacatgaggtcacattcaaaagttggaagtggctggattcctggaaaacttcactacaaaacaggcagaaagactcctagatggatagatctcagcattgagtgtcactctgcagacctcatgaggtacttcagttctccttgaacaaacttatagtcactgcccataccttcaaattcaggctgttcccattccctgacaaggtgsccctgttccatgatgccctggagttccctaggacactccattaacttagggaatgatgaaataacctagtcattcccatttcctctttacaattcagtttggtcccactttctgtctttccctgatgcaataaaaatgataaatgcgaaggtgtttattggagttatgtgcctagttctgtgctagagcctgtggaagaaaccaargaactgaaatacccagcctctgacctagtcactgtacaagagttaggagtgagaattctatcaaaggcacattcttatcacaataagtctgcaggatctctatgactactgcaaagaaacaacatgcattgtgctatatggcttgagaatattgattaaaacttcagttttgatgttgtaaaagcctgccatatctaatggtttccagtgtttctcgttcattcttttcaaacatgattcccaaatttggttagggcaaagctaaccctgaacattgagtctcatatccaaatcttatcagaagtatcaaaacttcctggttgtgcaaattgggttgaacatcctataataagagacattctttggatattttggccatgcaccttcctggcccagctggaatcaagaagttcctgagacagaaaaaaatggaaattaaccgaaaaaatcaagttatctctcttctgggaacctcagaacctggtttggtttaagtgcttgcaaatatcttgtattgttcttatttggtctccatgtttcacatttctctaatgctttacacaaaaggatgccaaaatgagatgttgatattccttccttttaccccggcctccagcatttctaccaaagtctgtttcctcctatccaaacaggcacctccctcctttgcagtggcctgaggaggaaatggaaatactaagactatctggaatttacagtgctctcctaagggattacagaccttcagtcaaccaaccaatttatttccttaatcctttgagggtaaaacttagactaagcatttcaaggggagtagtttgagggccaaagtaaagaaaacttttcaaagaatgagaactatccacagtgaaatggagtgccttgtgatataagaagttccccaacataaggcattcaggctggacagctgactgaacagaagattcctgcactagaaggcaggtgagacctaggtatgcctcttttctttgtaattgattctctgactttatgtcccattaacccacgattgggtatattagtccttggccacttcattttgagttgctattatcattccttggcccatccataatacttcatgcctctactagaatacaaaccaggccgggcacggtggctcacgcttgtaattccagcgctttgggaggctgaggcgggcggatcacctgaggtcaggagtttgaggccagcctgaccaacatggtgaaaccccgtctctactaaaaatacaaaattgagtcggttgtggtggcaggcacctgtaatcccagctacttgggaagctgaggcaggagaatcgcttgaacccggttcaagcggttgcagtgagccragacggtgccattacattccagccttggtgatgagagggaaaatccatctcaagaaaaataaaaataaaataaaatacaaaccatactataccttgtaatataacaatttatacattaatttatttattcacttgattgaacagaaatatatttgagtcctgcactgaggaatgtgagagagagagagagagcatggccgttaatgaggtgaagtagaaatcatgcagatctggctctgctctcttaaattccattctgacatggaaaccttgagtaagttactcttctgggaatcttagtgtcctgtagaaaatgagaatgataacatctacctggtagaaattaagatgaatgatatctacctggtagaaatgaaggatgcagagaaaacactctgtgctgggtttgttaacttgatgggtagttcaaatgttaattctctgtcttgttcatgtcaggtttccttctttgcactccccccaaagctggctctagggacccacacagaacagaagctcagtcaacattttgttgaattaaacacagttgcgtcagcaaacgtttgctgcatcctcagaactgcagcaggcactttgagaagcttcagagaagtactggttctttttctgccttcataaagcttaccatgtcatcagaagggtgttttcaactagaaatagtagccaaagacccaagagtgagagtgtaagatctagagggagtttccccgaggaagaaaccacactgctatcagcttactcagccagtagtgatgagagccagtgtgtaagatagaaaagtcctttgcccactttcagaagatcctggacaaattataaaaatagcatttatcaacttcttccaggctttccaccaaatttcacgaatcctactaaagctactacaaaaataggaatcactgttttcattttacagattaggacacaaaggctcagagagcagagtaacttgcttcagggctcatctctataaggggcagaaccaagatgcaggccactgtgttcataatagaaatacagctacaggaccaggcagctcaagcctgctccaatgactgacacatgagaacaagctagaagagctagtgtcttttgcatcttttaatatgtggtacgtatttaaggaacaccgggaaagtgggcattccctctctctaatacccaaaatactgccctacaatttttgcctgctgctaagatctccatcttttggcccccattctttcacccattgccctttccagagagttttctaaaatgtgtgtatggaaataagagagacacataagtgttgtaaattgccaacccttgcatgtaaaaattatttcttaaattttggaatgtctgcttaattatagtagggatatggggagaaaaaaataataaatgcacaaataggaagaagaaactttgctcaatttacagttttgtcacaagctatgtgctatacataggaaaccttaaaatgtcagtgaaagggaattgtaagatgtgcatattttctttctttttttctttttttttttggcaaagtctcactccgtcctccaggctgaagtgcggtggcacaatctcggctcactgcagcctccacctcccaggttcaagtggtcctcctgcctcagcctcccaagtagctgggattacaagcctatgccactatgcccagctaatttttgtatttttagtagagatggggtttcaccatgttggtcaggctggtctcaaacttctaaccttaagtgatccatcttcctcagcctcccaaagtgctgggattacaggtgtgacccactgcgcccagccagatgtgcatattttctgatggctgccaagtctgaggcaggaggggagaagccattcatctgtgtcttcttcatccttgtctccacagcaagggactagatacccactagggtattgtatggatacaaggataagaaatctttccacgtacacttatgatgcagtgtaggaagtgctcagagaggcggactgagaggaggtcagggagaagtgattgctgagtttcaactaagaggataagctggaggacaggagagggaggacgggagagggaggaaagaatcacataatgggggctgcgaggggtatatccaaaaaaaggtaaataatagatgaaggggaagtcaagagagatgagctaggaaacatggttaggaaaatcctgccaatgcttggaacttgacattatcctgagggcaatggggagtttttctgagtttttcagcagggggctaacatgtttggatcattgaaagaagaacattgacaagtgttgaacacttcttacatgccaggccctgtattattttgcatagatttcagaacaaccctgctgagaattcttaatattcctctctcaaaatgaagaaactgagtctcagggagatgaatcaccccacccatggtactctttcttctgttttcttttcttataccaggatactggtattgcattaaaacagcctcacttggaaattctgcattgataagcaattctgcaatgctaattagagtgtgctatttgcaaagggcaggaagaaatcctgtgctctatacccaatgcygaagtcacttctaaggggctctctgccccttccttgcctgctctgcctgctatggccttcaccaaagcaytcatctcctctcattagtgaaatgagagagcctttgccaatggtggtggaaggaggaaaggcgaagggaacatgctgaaatttcagagacaattccaagcagttttcccaaatacccarrggatctgctttctcctggtggtttctgaataatttttcaagagcacgtgtgcaagtcatctaaggagacagaacagaaagtaccatggtctagttcagcctgtcccatggtgtggggcaccaaaaaaatccctccaggaaagtaaaaatcagagcctgcctcagaaaggagcccactgagttggtcactataaccacccccaaaactttcatggaaaccttggactgtgggagactttaaatctactgaatcttatggggccccagcaaagagatctactagattctgctcctggctctctcttctattcatcctttggtcatttaccctttcaatatctgttcaaatctacaaaagtctagacactctggccctaggatttggactgaaaaactctgagtgactggagctttataaaaaatgagatctaggatcagttcaacctgattttcagttctagagtccaccacttactagctgtgagactttaagcaagtcagttctctttgcccccaccccagtttttcatctgtaatataggagtaataacatctccatggcaggtatttgtcaaggatgagacagttgatctagaaatacagttttccttctggtagcaaccgacaaagttttaaagaaacacttctgtctgcctgtgaagttttggcaactgaggaacaaatcsaattaggaacaacatgtggactttttttttttttttttttctaacagaatagtatttggggcatagaaatttaaccagagagagactttgagagtctcttggtcttacttcacttaattaagacttggttttgattaaacaacttccctgaacctctcaatcccatccgttataaaatgattctggtatttggattcaaaatcaacagaatcttgtgaatcttctgggtccaaagcatcattttcaacatgaggttgaacaaagcaaccactgctctcaggcagtaagttatgtgccatggaggaaggaagacaccaaaatagcttctttcgataagaaaagacaaagcttgcaaagtgctgtgatatgtggacaaatggaattaaccttagaggttaacctttgaggaggaagggcgaacctgaataaagtgacaggttatgtagaaagtgatttttctttccacttgggcatttgggggaagctttaaaaaacattgtagtgtagccatattgtttcacagaggaagcataagctttaaagccagaaagacctgacttgggtactgtttgttaccagctgtctgatgcctggcgaatgatttcagttttctgagcctcaattgtcctcatcttcacatgatcctgctgtcattctgtgagatggtatgaggatccaatgagctaacatatataaagtgtataatacgtggctacgtcttgcgaggcatctaattcttgtcagttcacatccctactaaactacattatccctgagcaaattgaatctggagaaggaacaaaaatgtgtaagagaggaaagcaaggaagggatgggtttggcatttgtaggcatacaacaaacwcatattgattgatcagggaaggtgccacgtggaacggtgagatcctgctttgaatagcgagtcttcatttttcagttgacacttgactcttgacttgaagcccaagaataagcaaggctttgtggtttggggctgcatctactggttctccatgtagactagataaaaccctgccaaccccttccatggcccatctaggaagattccttggcctctgtcttcctttttcttccaaacctggcctacccctatctcattaccttcattctccacatcctctttagcttcaggaccagaaacctttcttttatccctgtcatttgttctggctcccttaaaacccttctttgttcttgtctttcattttcttttcttttctttctttctttyttttttttttttttgttattgttttgttttaagtggggtcaccagcattcagccagcatggcctttgctgtgtaatttagtttcatgttctgtacccaagaaacatgtaaaaaatgtaaacagcgttcactctcctgggctgtaatgcacttaggaagcaatagccagttgagcttgctgagcctgctgctttggcggtattgaattttgtccctaaaaccacatactcatttctctaagtctgaaagtaaactttctcaagccagrcccaaaggatggggttttgaggkgagttagagtttggctgtgcacaagattttgtttttatttttgtacacacaaatgtgttcatttgtttttgtttgtctttcaagtcccctcgtctctactctctattcctccccactctctattccttcccatccttactttgataaattagactgggtatgttacctgtagaatgagaccagaaagggccttctgcctcctcttaagaaactccaaccaggccaggcgtggtggctcacgcctgtaatcccagcactttgggaggccagggcaggcggatcacaaggtcaggagatggagaccatcctggctaacacggtgaaacctcatctctactaaaaacacaaaaaattagctgggcgtggtggtgggtacctgtagtcccagctactcgggaggctgaggcagaagaatggcgtgaacccgggaggcagagcttgcagtgagcggagattgggccactgcacaccagcctaggtgacagagtgagactccatctcaaaaaaaaaaaaaaaaaaagaaactccaaccatgattttcttaaaccctgattaattcttcagccagatccaagcaccagagcaccctgggtacatttgtacatgtttgttttccagggagaaatgggcccagagaggcccatgagagatgtccctgctgagaggttccctgtgccagggcagtccaaaaaagttgtccctggggctcctgcccaccccagaatccttttccaaacatgactcatatgtgcaggtggtgaaaggggacacttcggtgatgtctacatttctctccttcctggaagagaggcccctggggaagtcacaggtttgggagagatctggtctactggcaagatactgctttcagagatgcagatgccacctgggtaatgcccatgtctgcagtgcaactgactggtggcaaggggtccaggaagagaatatcaatttaaagcaacgggaaggaggagataaactgacatgcaccagggagctacggtcaggggtttatgtttcagagagagcaaaattgtatcagtgttcacaggccaggctccagactatctgtccagtagaamcttccatgatgatgaaaatgttctacatatgaatgtcctgttcagtagcctctagccacctatgatattaagccctaggaatgtggttcatgaaactgaggaactaattggtttaattttaattcgttaaatttaaatagcctatttgtgggcattgggttcccctactggacagagcaggtctagagtacttcacatgccagggctgctacttgcattgagatctcgagcaacttaattagcctctctgtgccttagtcctctcatctgtaaaattaaataattaaggggagatggtgagaattccatgggatagcacgcttaaagcacttaggacagtgcttggaatagagtaagtactacctaaattcattcagttctgtcattgcatcgaatcttttttttttttttttttttttttttttttgagatggagtctcactctttcgccaggctggagtatagtggtgcaatcttggctcactgcagcctccacctcccaggtttttcaagcgtcctgcctcaacctcccaagtagctgggactacaggcacacaccaccacatccaactaatttttgtatttttagtagagacagggtttcaccatgttggccaggatggtctcgatctcctgatctcgtgatccacctgcctcagcctcccaaagtgctgggattacaggtgtgagccaccacacccggtctctccagagatttttaaaatgacatttctctttcccagagtgagatatgacatactaatctttttgtaactcaatgtcttaaattttttaagtctgcataaattctcactggaggacttttgcttttggatcatattctccgtattcacaagaaatattggtctcagtgatttctcacctgtgaagctctctattttgttccccatggcctataaactccaaaagtcttagcagacaaggccatgcacaatctctacctttgctttacagactattgcctaaggggcacgttccaggcagtatggaccaacttgcaatttccagatatatcttggggtttccttttctcctgcctggaaacaccatcatttgctcctcaaccttcttagggcttaattatcctacagggtttagctcaagtggctcctcttccatatccctcccctgacaacctcagcccatgagcagcctccctcttccatgtacagaatacttctggaattatcagacaggcttgagcacaagctgactttcagtgtgcattgcttgtgtccacagcttttcataccaaatgaccggttagcagctaacgatttggccctcatcttatgcctttaggtatttcctgtgcccagcacaggacctgctgtgtggacaatactcagaaaatggactcattaaatgatgttgttgggaacaatagctgctgggtgttacctcttttatgattggattaaatttataaatcggtgtctacaagtgattcccttatgtttccggattacagcctcctgttaataccataggtgatcaaagcaggcagggccttctgaaatcccctgtttcatcccttcacattacaaaggagataagtgctactgtgtgaattgggggaggaagaggtcccgaaaacccatcctgaacccagacctcatgttctttctgctactctgtgcctccataatctatcctcacccccggaatgttcactgcacagtgagaagggttgtttggtaactgtttttgtgtgcttactcctgtgtgttccagcatcaagaacagggcctggcatatagaatttcatgataaatactgataaataaatgtttttttctctgctaacagctttgggcaaaaagtaggaaacagcttctggaggctgagcgccaggaaggaagctctaccctttgcttcttgtttttgcaggaaagattggggtctaagcaattttcctgtgattggcttcctacagagatggatggaaatctaagggtcttcctttctgacttgagaatgtggttcaccttcagagagatctcccaatacaaggcccagcacaggagggtgtgaaggagtaagaggaagaaagatgggaggaagaagaggtagaggtaaaaggaaagaaggaatatagaatgaagagacagagaaaaaggaaggactacacaataacaacaaataccagtaataaccataatgtaatagtaatcacagaaattgataatgatgagtagagtaaagagaatggcttggctgtcagagtgattacattatgtagagaactctacactgttttttgtacatttaaacctgtcaaccacygtatgaggtaactactgtaattaagactcacaaaggttaggtcacttacccaagttctacaggtagcccagtggtagaacagggaagtctagaatttgaaaccagarccatgtccctctacagccaggaagaaagaagcagcaagtgatggaggaaaatgtcaattttgtatttttagtgagtagggtgtatctaaatatttgcatgtgcaagagctctttgaatcctcacaatgctacaacataggtaccatcatctcattctgcagtggaagatattagagtttatgaagggttcaaggccatgttgtcagtgaatggcagaagctgaaattccaactcacattcctttgatttaaaatrcatgtgtcttctggtgcttagtggaagattcagggaagtggcaggtgcaggggttgttgagaagttcacattgtggatcccagattctcaggcactgcatctcagaacagctgcttcaacaccctgcgtttgtgcagatgtctgttgccctggccaaggctgccactagggaaaagcatcactctggaaggtccttgttcctcagagaaccctgctgatagagtggtggacatataagtcaacagtgtccattgcacctgtggtggacaaagctccccggtttgtacatcacagtcactgtttctacctctgaagcctggaggggcaggccagggagaaataccacttttgtctttaaaaatgggagttcttgtttgagttggaaggtctgcaggatgctgttaaaaacataagtgactgctgtccacctgttcctttcatacatcactgcattgcatcctttgragactcttcctaggaaaaatcaagctcgaggcaacctagacaagagtactgcctcctcttcaaaagcaaaaggaagagagcgaatcatgtagtgattcccagcccttactcattgaggctataggaggggatgggaggaccctgaggtctgcagtgagaagcaggactcagagacaatgcactctgcatgatcatcttggcatctagtggggttccctgcaggtaatgtgacttgtacttcaatttcaacacaatctggaacacacagatcttaatttggaaagctgaataacaggagaaagggggaagaggggaggaaacaaaaacaacaacctggaaacttctagttttatgaacttgagaaagtcttgttctttcaagacagatgtttttaagtaaaaaatcattcctctgacctttcttgaataggccgatgcggtcaagactgccattaaccactgttcaactattcataaccaagggtttcggtgaccaggcaccgaacttggatgtgatcatcactttcctgattaacccatgaatgcccagggactttgatttaaaatcaaaggacaaagagaggtgtagaagcttcctaagacatccccctttagtcttaatagctctgagctgagtgatggagatgtccatattttagtgccttactccagggttgtctgtgtttctgaatttcactctagagccagcagagaaagcatttggattaaagctaagtagatttttgttttttatcttcagtgtctaaatctcagtcagtttcaggtttggggctatagagcagaaggcattacccasccctgttttaggattatggtgttttcgtattctggtccagaacttagaagtgtttcagtgctcaacatactgctctagaactgacaatgcctcgggccctgaaataaaattcatgatttttcaggattcttatctggagctggaaatgcctcagaattttctactgctggcaatagctctgtgctcctgtctagagttgagtgttcatcctgactgaagttaacagtgctctcttgatctgatccagagtctacactggttttatattctgatctagaattcatgacatttcattaatttctttcagtacaaatgcaaaaataaagtttaaactacagaaagttagcaatgtatttttttaaataacgtgctcagaactgtgtttgcaacaatattcagcatctcaaacttatccttcacgcctccgctgttgacatcatttgggaaactgggtttgtcatggcttagctgtggccgagtttttctcctctggccattttttttcctccagttcctgctctccagagcccatttgatattaagatcttgcctttcagacctggccttcagatatagattgcctcagcaactcccttctccaagcccctccctcagccttcagagagcttgaacacagaacctaccacatttctctatgagtgtttgcttgcttcgttcttcacctcccacccccatgggaggagaaggaatttttatctttgttgcttttgttcctttggggtccattttcttcatgtggaccatgggaatgaagaacctaacacataaataagtgctaaataaatgttgaatgaatgaatgacagaatgagagagacatagaaacatttgatcctaggctggacagaaaaaaaaaagatgctttcaaaagaaaacagatccctgggagcacccaaaccactgcctctcaccctgtaagaatacaaggaaggttttgcatcccactcttttaaccccgtcagcatcttactcttggaggtagcacatgtgctgtgaagtcacccacggaccatctggctggggatcccgtgttcctcctctgcagcaagagattacgtaaactggacagcagcctccagatgttagcagtttctgctcatttttttcctcccttttcaacaacaataataataattaaaacaaacacaggcctcatcccccacccgcacccctgaaattacaaacaggtgggcccagatgtcctcccccttcccatccaagggcctcctattcttgaggcccagccgccgaccctcagcagggcctgccctgggctgagccggacagtcatgccagctgccctgtggctcaggccacagtctcccgaaaggggaaatggccatgtcatgagaagtctctgtgccagactttccctctccccgcctcccaccccaaagccttggcctccaacttaaatggatgtattttggaggactaggtggcttaagagattagtaatgagatcccaagtctttcactgctgggtcaggagttcataggcgggcctgggcgactagtgaatggcataattagggagacagggagcaggcctgcggagggcccgtgtgaaatgagcccagccaggcctttaatggcagcagttgtcagcagcacaaaaggcggccgccacatccgacactaatcactctcccttgttagaggatttactagctggaggagctcaagccccctgcccatctcctcctcaaaacgggcatctgggaagggactcggcccaatgcctggctgtactgtctgcagaacggggagctgatgccaaccccatggggtagaggtgtgagaactaacatttcatgcaatataaatgagtgactagtgtcattatattaatcagtacttccactgctattgtgaattttctttctccatttgaaaaagggggtggggtgggtgatgaatctccccatcacagtgacataaggatggtgtccatggaggtggaagcatttggatatttatcatcctcaccgttattgtcatcattctcattaagatcagcatgtacactgtgtgggtctcagttttctcatctgcagaatggactgggaataggagatagaactgaagtaacacagacttcaacatccactccgaacaggtgtggccttggcaccttatttattacctctgagcccaggctgtttatctgtaggacaaacaagaaggaggatagtaatactggcttcccgggaatgtggggaatctatgtttggaacataggtgctggacagtaaatgatggcaaagaaaacatgttagctttaccactttcatgaatggtgtcttaggcctctaacataagcttttcccttagaagaaggttgagacatctatctgttgtcccccagaaatcctgaacctgtgtgtatgaaattgaggaatttaatgagtagtctctaagaatcaattctatgattctgaaccatatcatttctaagaaacttagtttccctatctgtaaaaatgttagtatgctgtagggcaatacgtcttatatgatttctatattccctttccattgaaagcctggcttttcctccatgatcatttggtctggccaggggtttgcaccctaaatcccaggatttcagacttgtggggaggtgccagcctgaagggtatgagacccctaaggagtgtgaaatgcctaatgygttagggacagatccctggagcaacgaggtgctaatcagcccagagctgagccccaaggctggagggcatccaatgccaagttatcttatcagaaagtgtctcctgggtagaggctctgagatctgctgctatttctagaactctgggagggaagaagaagccatctctctgtttcacactctggccctgcacacaggaaatgcttctttccttgattgtctgtctatgccgaataataaatgctcatattgaaagaaacgcaaaccacccctccctttcccctctatctctttaaggcaggcatcaaaggggaaagctgctctggaggcctggggaaagtgataattgtttctaatggttggtaaaagaaagcctggctcccccctctcttttttctgccattgctattaagtgtgtaaaaaggaagtgtgtgtgtatgtgtatgtgtgtgtgtgcctgtgtgttgtgttgtgttgtgtatctgttaaccctcggcttcccttaaagttttctgtgttcattggtcagtttggaattagaggcataagagggaagcagggatagaagtaggaatgaagagaagatctcaggtaggagaggtctatagtgctccgcaggtagtgggagaggccctgaacctgaagttggaagatttgagttgtgtttgttcattatatgcattaactgagatgagacatgtaaagtggtattgttgttatacatttttttttttttttgagacggagtctcactctttcacccaggccggactgcagtagtgctatctcggctcactgcaggctccacctcctggattcactccattttcctgcctcagcctcccgagtagctgggactacaggcgcccaccaccgcacccagctaattttttgtatttttagtagagacagggtttcaccgtgttagccaagatggtctcgatctcctgacctcgtgatccgcccgcctcagcctcccaaagtgctgggattacaggcgtgagccaccgcgcctggccatacattcgcttagcatctaagctggaccttcctctgctcttaatactgaagatagaaaagacaagagctcattcttcccctcagtgagctaatgaccaagttcaagaattgcaaataggattcatcttctaggccagttctgagcaattagagtgactccccatagtgttttgttgagaaggatttagaggcctaccttcagggatgcactatgtaattaatggtgcctgtcctgtgcaatggatgagagaatggtagcactgatgtcacgtgggaatgagtcctggttctcctggtccctttcctgcactacatggttattattatctctaaacattggtctaggccctatagactttgatttctagatctaatgcgtcaccaatcttataaagccttgggaaagccatattagtttaacataggggacatttggtgagccctgcccagtaacctgcattagacactgatgaaaaggaaagagaagtcaggcataggcactgtctttgaagctcatacatggagattcagatggacaaacaagaaaccataatgcaagtgtattacctcaagggtatggaccaagagttattgggaggtcaagccatggagtaagaagagaacagactttgcgtcagacgagcatgagtttgactgctaagccgtggcaggctgatcaatgcctacccaaacctcagagtccttatatctcaattggggataaagatgcttatttcacaagattattaggaaggtaaaatgagataatacacaggcagcacccatactgggcagaccatctttaagagttggtgctggccaggcgcggtgactcacgcctgtaatcctagcactttggtaggccaaggcaggtggatcacctgacgcctggccaacatggtaaaaaccccatctctactaaaaatacaaaaattagctgggtgtggtggcaggagcctgtaatcccagctactcggggggtggaggcaggagaaccgcttgaacctggtaggcagaggttgcagtgagctgagatcgtgccatcgcattccagcctggggtacaataggaagacttagtctcaaaaaaaaaaaaaaaaaaaaaaagagctggtgccctctctcactctcccaggaaagcactgaggagggagaacatcatctgataaaaacagcaaagcctggtttatggaggaggttttatttcacctgggccattctgtgtccaggttccctgaggccctttacagctgtagtcttataggctgtctcccagcaggctttccctcctgtagtcctcaggacccttaagaatcttggaggtttatatcaggaaaccaacttctgtccttcttgcacccttgcaattcttgggaaataacctggcattggaactgcaagcctgaggttaaaatgtggcctaaggagaaatattgagaaayactggctggctgtgtgtgtgtgtgtgtgtgtctgtgtttgtgtgtgttgcacacttgtacatttatgggtactgttagtgtcagtatccatccccgcactcctcctccccattccttttcctattttcttctataaggctcattcgcaggtccctttgggtggaaaaaggaaattggagaggttggactagaggcttgatgagcacttcctccctcccatgattgacaaaagggcatgtaaatctgtaaaatcgaaattcaatggaaacctcatggcatgtcccctgtgtgggaaaataccagagcccccgctccccctcttctccctccgtctccctgcctttgtgtacatcgtgtgtgggtggaagataaactggatttaaaaaaaccctttgaaagcaagacatcgttaactcctctaattgaaagcagtcttctgcaaaggagggggatttggaggcgggtgctggatgtagcggctggcagtgcactgagtggacaagagtctctgggtcctggagccacagagtcctctgtttctgcagacctggaacgcctagtcaccaccagacatcctggcccgtcacagaggagcttactgtatatgttcaagccggtctcttctccctccaccgggctatgtttctccatccatcaaatgtgagaattggagtaagaatttctgaggaccctcccagctcagatatccagtgatcccaaagctctggacaaaggatttccccagctattttgcagcttscaattgcagacacaaaaagaaagaaagagagagagagagagaaaaaaaacacattgctagaaaggctgcagtaaacttttatgttactgttctgattgtctttgcccaaaaaggtgtcttggaaattagccttcagcttcagagaaagggacccataagtctcagaagtcaacaggatgttcacctgctgcacagtgtggctttgtttgtttctttgtttgttttacacttaattttagagtcaacattcttttctgcagcattcacctgagaagctggaaatcaaaagctggcagaatgtcaggactgaaaagccctttggagatgaattcatcttactctgtctttccataaataggaagagtgaaggtcagaaaaagtgagcaattgagtcagttctaggaggcaggtcccttgcctggcaattgcaggctctttctactgtatcactccactccggggcagacctgaaaaggcctgttttggtctgttgaagcagcttctatttcaggagccccagggaaagacaacaagaagtcccaagtccatcttccatgtggctgggattaagaccccgctagcacaaatatatctattctcttrtttaaaaatctcatcacagccctgagagacatgtgggcaggctctcttgaagttaacatctatggttaagaatgtgggctaaacttgtgcctggatttcaattttggttctaccgctaactagttgtatgaccctaggtaaattactgggcctcgattttgttatctgtaaaatgcatatcattgtaatacccacctcacagagtcatggtgagcactgcatgatttagtacatacagagtccttaaaacagtgcccagcatagaataggcacccgatacatgttgctgctgctgctactgctgctgttgcctgctgggcccctattatttcctgtgtgctgggaaatctgctgggatttatttgaggataaataaaacatgcttctcaccttggaaatcttcagagtttaaagagatgaggctggactctatacaactataatctaacttgacaagtgctgtaactgaggtataaataaggaactatacggacacataagaaagagcaattaattctgcctggggagtgagtaaaggctttcagaggagggatgatatttgagagtggctttgaaatgcgtgtagtatttcacaaaatgggcaatgcagcggtggtgggcgtgggggttctgggctccagcatcatggagggggagtccacaacatgtgagagaaagagttgtccagcatgaaggaagcaccactgtatagatgccagggaagggagcacagagagcagtgaaattggtggaagctgctgaaaccagctcctgaaaacctttgtaagctgtgtcaagggaaggttccatcctgtggatcatgggcagcatggtgggtggataagtagcagggtggtatggttagtttttctcctttggaaagttaattatggggagcatttttatgaatgaatgtggtgggaccagaagcaaaaagactggtcgttggtgccctttctccaccagaggaagtggaggtttcagttgagtccaagtagcaattgtgttgctttgtaattaagtacgcagaacatggaattctagagatcagtcaactcctagttgtgatatacaactggatttaggaccttgaaaggatttttcaaagcctctgagcctcattttctcaccagagaaaatgcagtggctctaaactcccagactatcagggttaaatgatattgtgactatgaaacccttggtggatattatgactgtgggtgtccttaagctcctggggcccttaaaggtcattccgtgcaaccattcagtacaactgcagagggggaatcggagagtcagagaaatgtccagttaattggtgacagagctggaattaagccaggtcttctactgtccatggacggtatttgaaggaaacacagaatatctctgcagataatggatagtctaagggattctgctaaaatgagtgccccccgcccccaaggccaagtggacaaggggtcacttgcctttcaattcctccaggtgctaggatgaggatgagaagcagtcatctgcccagcttccataaaagacacagggctgggtatcttggagaagagaatggtgttgggcactagaattgccgtctgtcatttctgccatgatttcttgggggaagagatataaatgtcactggagatggttctacacagcaaaaaataggatcaataaggtacagaacataagtgagaaaagtgcactatttctgggagacagaaaaatttgctttttcataaacgtgttgctccttattggctgtatattgccgtgcaagatacctcccttcccttgaccactgcaaaggggaatgatctcagcagataacctattctagtcccatctaactttaaaataagaaagcttataggcattgctacttagaagaaacagtaggagaaagtggatccaggagtctctctctctctctgactgttggagaggactgtccaatggtacataggctttctataaatggaaatgagctgtatgtccatgaagtaatcaagaggcttatgtcatccatcctccaacctgagaggacctaagtgagggtgcttgtcagcccaaccacacctgctctttgcctaggactactatatcaatttatttttcccttcacttgattattttatgtaaaaaatatttaatgtatttatacattaataaatgtaattatttattgttgtcccaggacaacaaagctgtgacctgaagccaccccagggaccaactattttcttggaataagggctggggaagctgcttatagggtcctgctagattgcccaggatgggaaaagaagtaagaaggttttctgccaatgtagacaccattaaatctgtaccaggggttcaaagagtcaaatacattcaggccagtggatcaacattgaatgtcaacattttagtcattcaaagtaataattctttattttttattgtgggaagagcacaccgtgagatctaccctcttaacaaatttttaagtgtatggtacagtattgttcactataggaataatgttttactgcagagtcctagaacttattcatcttgcttaactgaaaccttatgcctattgattagtcactaatcacttttcccttccccatcccctagcaaccaccattcattttgtctttggttctatgaatttgattattttagatacttcatattaagtgagctaatgcagtatttgttttccatgtctggcttatttaacttagcataatgttctcaaagttcattcctcttattgcagattgcagaatttccttttttaaggtcaagtaatattccattgtgtgtatatatcacatattctttatccattcttctgttgatggacatgtaggttgttacatcttggctatcatgaataatactgcaataaacatgggactgggcaggacagaaaaacaggtttgagctccatggaatctctccttatctccttttccatttccctagggaaacccaaagcctagtggttgcctgtgtttctagagcactcttgatgtgttccacaagacagggagcaatgtgaaaggagggaccaggtcttgttcacaccagcatgacagagaggggaaaaagggttactgtgttacttcctgacatctctagggctggaaggctgggaagaaccttggcatcactggaaggatggaaaacagtatggctctgcacggggtataagaaatgtgcagattgggaagggggaaaaggttaagattgggaatgtcaccggagccagtgtcactgaagaaactggaggaggggagatgatgagcgaagaagagcttaggggtgatggtagggagagctaaagaggcccctagaatgcgtgatataactctcctgcatgtctcctcccaaaacattcagtaaagtcaacattgctcagcaatgctttatggagttggatttgcctttttggaaggtgaaaaaaaaaacacaggcggatgaaaacagagcatccccataaaatcagtcaccttggggatcacacttgtgtccttagtggccaactttgtatcatgggcaagcctcttttgtttgcagttctctgaagcctggcatgccatatgccctcagtaaatggctgctgaatgagcagattcactcaatgtctatgaaagcaggaggcttgtaagggtttgcctctctcttcctctccagcctccctccagttccccaggaacatagattattttgcagatcaactagggctttgggcaaagtttcagctggatttgttcattcttctctgatttgctttgactgtccttggtcaggattgcagccaacttgaaacaaacacaaaacaaaataggaaaacagaagaataaaataacaccagtatattcctttaaaaccctgtctagtgctaatagaactgacaagaggaaatagtatttaagcaataagagggctttgttcatgtcagagaatcctgtagctatgaatgcttcagatgcagagataagacccccaatccagccttcagagatgtgcttcaccaagctctgctgggagacaggcagctaagaacacaaggggaaagaattccaaaatgatacatgtcgaattgctggcctggatttcaaattccatagatagtttatgcaaagtcttgcgctgttgtaaagtgtaacacaatccactggcagatctgcctaaacccggtcccagttgtttttgagaaaaataaataaacttaaaaacgtcttccagcccatttaagtggctatgttctacccttagcctcctcagtgtgaggcttctagagatttgaataactgaagccatcacctaatttgtcagcaatgggataggagattcatggcatgtttcttctcaagaagttaccagtgatattcagagaattaatattgtgctttcagaacctatcaattcctagggccagggtgaggggaactttggcagctaacacatttcaatactttttgatgcttttaaagcaatgaaactcttttcttaaaagaaatattataaggcagctttatatatacaacaggtgagtgcagatgctctgtttgaaatagtagagtggaaactaagtagatcttctctacatcatgatcccctggccaacttcttcatggaatccaaggaatccatggaagacatgtgaaaacctattgtctaacccaacattcggatgtgcaaggtaaactaagggccaaaagacaagacaacttgttcaaaattgcacaccacattttggttatctgtattatccatattgtatttgcaactttactataaatatgaaattacttcaacaaaagttttatttaaaaataaaagtattaatgcttgcaactgcagattataatgcaaccatgtgctttgattagtgtctcattattataaagagaattgagacctggcattttccaagacctcctcgaagccagaaccattgcaagaagtaatggaaagagagacatttgaatttgcacagatttatagatgggattcccaggatggaatatagcatagaatatagatgggattctcagcaagatggtgccaagagtaagaaggatgggctgtcatagaaaattcagacctggtcccgttcattggagcccactgtactgaacacattgttaggaaaactgatgttgatggttttatatctattttcaatggctttctaagctaacagtttggattttttttaatttataaaattacatatgatgatgtaaaccaaaaccacctatgtataacaggtgtatgcactacctgaaattgacaactatacaagtttttcatatttgcttcatgtctctttctgtaagaaaaataacacaccacaaataagattgaggtccttttttttcctgactcccggtgtcatttcctttccttgatacacagaggcaactaccaccctgaatttgatgtatagttctctactctatttttaattcacatgaatcgctgggcaatatatagttttgctttgtgttatttttataaatgacgtcatgatgtacttatccatttgcaccttrtttcttttttcctctcaatgttatgttttgcgatctctccatgttgatgtctatgagcttaccattagggcttcctttttatttggctagagaccatactgagccaagtgttaaactatttttatatcatccttgtatatgaatccagtttatttctcttactgttcctttgccataatagaattctgtcatgtgaatatttcatattttatacatttctccaccaacaggagaacatatagactatttccaatcttttcctactatatttattgtagaaatggatattcttaatccttgtatatacttttccattttacttttgtttttgcttgttttaggtgtttatgtttgtttgatcttgttgaggatatatcactttttttcaatagcatatgagatcctcagggctctccaggtcagccgtacttttcggatgagtagaatgcactgacaagacatgaaatgacaggcccaaattcacagggaagttttgtgagagaagccacattagagaccagaggagaagtaccaatttgggatgaccttctaccaaagacctcaccgatttcaaggacagctcagctgttcctatcctctttccctcattgcactgttttctgtttatatttatatatacatttgtaattacttgactaatatctgcacacattgcctgctctaagctcttcagcatctgtcttttttatcattttgtcccagagtgtttgacaagcaatagttactcaataaatatcatttgaatgaatgaatgaaccagtaaacgaagtgacatttgaatatgcaagaaacccctaagtttgaagaatcctgcttgtctataaatgtttcctgtttcttttaatactgtttggtatttactatcattgagaatgaatttgtgtgtgtgtgtgtgtgcgtgtgtgtgtaggggtgtgtgtgtgtgtataaagtgatggaactgattttctttgttgatggaaaagcaaatactaatgttttcagtcttttctctgttgtaatatcacttggagcacaatttacagatttgttctaaaatcttctacttgacactcaagattctatgagatctaattgttcaacccacttttctgccactgtccctcagcctcagtagtaaccatttgatcacaacttaaggcgtttgatcaaacctaagcattctgggtttctgctttcctctgagccttgcttctgttccctctgcctgcaatgcccttcctcttatcactgccctactcttccaggcccaaatcaaataacaactcctccaagatttgtctccgtgagaatatctctgtcatctctaccatcaaaatatgttatctattatatccttaaaagtgttgaggattacctcttctacattagaatgtgagctcctggaccagattctggtcttttcatccctgttttttcctgtggtgccaagagcaaaataggtgaacagtaaaggtttgtaaaattgaatttagttgaacttctgacactctctaaaacatgattattttttctttatatttttccaggtgtgtcgaaccaaggtgatagatctcagtgaaggcatttcccagcatgcctggtacccttgcaccatcagctacccatattcccagctggctcagaccactttttggctccgggtaagctgaagctctgagagctttggaatctccagcagcgagccacagaaaacactgactcccatgaccctttctgaagatgggttgtctacctgctgagggtgttaattgtaagaacagggaacaaaacacttagcagtgtgatgcttcctgaaatggaatcctaattgctcatggaatgcccccactgagctcttgttttagcaaagagtttggatacatcttgtctgcctggaacctcctattcattgttcaagatcttttaaaattatcttttcctccttgarccttttactgatcaccagaaaaagaagtgaccattatctcccttcttgtcctgcatgtttggtcgcttgttggatggtacttgtcacatggtattacagaactgtctatggtctttctttctggctaaggattgtggatattactgcattttggcttgtgtgtcactgacctactttgaattcccaaaaatgcaagggccatatcttatttagctttctctcctcaaagccgagtgcagaggttgacatggagaagtgaaagataacagtatgcacctttttttgtgtgtgtgggttttagtgtggaccgggacctttgctacacrctttactctcattatcttactagaacctcacaacaatcctatgatgtacctgttgatttttttatttttttttaatccaccatttggaaataatggaacttagacccagagtggcccagccattyactcaatgtcacacagctaagtatgagcagagaaagattgaaattgggtttctgatctcagagcctgtgctcttcactgttaggtttcattgcctcctccttcccatcttggacccctgatgagtagyagcccagttcttaaaaaggaagtttctcctcaaatgcaccccmatgtggctgcctccccaccacatgactgagtgcacatgtgaccctcctacgtcttcacaatttcaggcgtatttttctcaaccaatggttgccgcagctgtcattgtccacctggtgacggatgggacatattatggggaccaaaagcaggagaccatcagcgtgcagctgcttgataccaaagatcagagccacgatctaggtaagcatgctctcttggtcttggcttgctttcagtacctgmttccacctctgccccataactagttgtgaggatcagcttagaatgagctcttccttcctttttcccctttcttgcttcttttctatttggcattctggttgccctcaaatcaagatgtggttatgtatccagagaaatcaagatctggcagatacagggataaggggccaatggccaagcactcccttctgccagccacctttaactcagacatcctgtattattccccacagaccccaagaaggagagagactgagtaagagccatttccccgttgtacatgtcaccatctgagacccaaagagaggcactgagagaccccaagtcacatggcaggtcaggaattactagttagattttcagcgtcatagcctattgctttttaccctataaccgggagtgttcatgaccctccaccccaagtggggactgtatcaccagtacaacctctggagaagtttccaatgagaataggaataggaatattgtaggagtagggaggcagttgaggagtcaggttctaccatgggaggacctccctgagtgcagggccaagggggaggacaagggctggacttggccacttgtaccacccctttgaatacccacatgcaccgtggtccagaggagagagcctgaatccagagctgacagctgaggtttggatcctgtccccaccactcactcaccttgagaaggtgagcaatcttcctgtcctcacagcacatcacttagaggctcacttgcttcacatacacagcaaggacaatgatatccaccttagagtcagagtgcactattatttgacactgttgtaaccatgcctagcacaagatcgggccctaagaattcctattgtcgctaagaatttcctatgacaccttcacacttccagtctaccctggagagctctgggcagcctggatactccaagtatttggaatttttggccactactgaagcctggacttcaaagttgtgcccacaccattctgcagagaacgcctttcaaagacctgtatgaagcaagccaggcaaggggtcatttcagggtcagataaaagccaagggagcagggaagattttcttgttttgtttttatgcttgtttatttagttccttttaaaggcaaggggaacctatgaataaggaagagaaagaaaacccctctggacttagcaggattcctgggaaatttccctaagtgagaaacaaatattttcatagttgtcgttgcacagcccagggctctgaggagaggttttttcagcagagtggggaaaagtctggttccacaggagctctttggatcctggtactgatgcctgaggcttttctgtttttcccctccacccccaccatcaccatcttcctcagtctatgacatcccagcattctcygaggcagcttcacctctggaactgagaagggcacctgcttcaggcttccacatgggagatttctccttacatagcaagcccgccaggacatggttaggattataccattttttggatgtgaaaactgagttttaggggctttctggagtcccattattaggaaggggctacaccagcatttaaactcaggtccacccaacaccaaagccaacttctgttttgctaattccatcttgccacagccttcctttccttctgtcccttgtgtatcttttctccctggccctctcccttccttcttggagaatgggaacctgctggctgcattaaaaaaaaaaaaaaaaaaaaaacagggctcttgagtgaggcaagcttgaattctccctagagttttagccatgcctgggctgtgcttctctggaaaaccacccctgcccacgattctcaacctcttctgcagactaagcaagaagtccttccctctcagggctgctcccaggttcacagattacttatgagagtgggctttttaccctgggaagcgcctgttgctatgaattatttccatcacttttccaactgaccaggcaggcagcctgaaactcagcaactcagaccaacaagccctacagcaatgtgggagggaggtgagggcctgggatgcttggctgaggggtggccatttgggggagggagagggactttgggcagtaggtgaaggggaagcttagggggcagggaggcagggggattggaaagatttggaaccaagaaaaaaaggcagacaaagaaactttcaatcagactcaaaatcctcaccggccgcccaatggtgcttttgtgcagtgacatgaaagggtctgggggcttcgggaagggcccgttggggagggcgtgactggccttgagtaatgagcctggcccctcggcccctctgtctcccctgacaggcctccatgtcctgagctgcaggaacaatcccctgattatccctgtggtccatgacctcagccagcccttctaccacagccaggcggtacgtgtgagcttcagttcgcccctggtcgccatctcgggggtggccctccgttccttcgacaactttgaccccgtcaccctgagcagctgccagagaggggagacctacagccctgccgagcagaggtaagggatccgcggcagactcgccctaggccacttgtagccgagtggagacagtgtgattttgaagctgggtagccatttgtgtggatgtaaaaagtctgtgcatttctcccttctccatccatcctctggcctctggccrgctctgccttgtggcccatgagtctctgaattcctggggcaattaagggaaacggttgtgtggtgaaaaaagaacctccttcacctggcttgcagcggcagaattgacaatagcttgcaggttgaccctggaaacatcggtttccttctctgagcttcagtgtcctcatctgaacaaaaagaggattagctctcttttatctctgaaatactggaatattctgcttcccgtggcacaagcaggaggcataaccttcctaaccaagggggatagagtgagactggtatttgcatcatcctagttcaccgtgtgtttcagggataggtgaaatctctatgtcttccacaagcctagctcctgtgacctcatgagtggtctaagagcctgtctttcaactgcatgacatcactccctcagtgcttttgaggtgccatctgttaatgcacctagtttggagctacaagcgagtggagtttcctgaaaagaatacgagctttgggaatactcttacttgggtttgaacctccacattaccacttcttgaatgggtgttcttgggcaagtcacttcagttttctgggtcatagttttctattttggaataagcagatgaaatctactccacagggtggttgtgagggttacatgttgcactatagataaaagtattcctgcagactgttaggcactatgcaaacataacatattaaagaagaatatttataaccatcttttgatgatgatggtgctgcttctgtgcacagaattttttgtaaagttcttaaagttagagctggaaaaagcttcagagattatctcatgcatctgacatgtccaaacttctgtgttaccatgtagaatcacagggcccagaaagggaagaacttgcgcagagttgcacagcgtctctcagatttgtttcatgaggtccagaagaagagagagttgtgatttttgtaggctacccaagagtgaggctctctgaaagtcgattcagccttgccctgtatacctgggggcaagaaaaaaaaaagagaagagggggacactagcctttcccacgcccctgttaccacagaggacacaaaaggtggttgcaaaatccacattgtttagtacccactgtctctagcttctgttgtgcaaagtctgtcgtaatctttcagaggcaagagcttcttaaatataattcattgtcttatttcactctaagaggatgttttccacaagcccttgttctccagaccctataaaaataagttaattctcagagcctagggaaaccatgtcaatggaaatccactagaccttttccacaacactttcccatttttaaccagccttcctgaccatccataagttgactgaggcccagactgacttgtttgaattctcgacgaatggtgtctgtgccctaagtaaatagtaggaaatatttaaccactgaaacatatcgattgatacgtatttgttagttctttggttgtaggaggaacattgaatgagggcaaaatgctgccctatatctgactaattatttgaccttggattagtcattccccttctctgggcctcagtttccccatctttaaaatgatgatggtggattgtgtggattctctgaggttcttttcagttctaaatctgtgtttctcaacagttaggaaacatgagagaggacaggaagggacaaacccttgttgagcccttaatagaaaggaacattatcttattttattattgcacctcttgaatagataggaacagtatcttattttattattgcacctcttctgcgaggtatggctcagagaaacagagtgagtgagtcatgaccattcaggcagtaagaggcaaaatcctgctttgtctgtccctgaaagccgtgctctgcctaccacagcaaggcacgagtagcagagaaggaattttcataactggacccatgtgatgatttattcagaggaactctgagtaaggggatggagctgcagctctgaggtctttggctgccttatccctgagcttggatcaggctatgacaggctgaatcttgagggctgaggctgcagggcaggagcacctcctcctgagtgccccagtggggaaaggacagcagctgttcatggggagctaaagaggcatttaccaaaacaagcaggactctgcaaacatgcaaatgcattaaaacaaacaaacaagggaggaaaggaaagaaaaataagcaacaactgtaaagaaccatgggatgttttccttcattctcaaaacaccaaaataaatagcatcactttttataacacaaatttcaactggttgtaggagaaacatcccactttactctcagctgtttcccaggtagtgaaaagtactgtttttcccctccccttctctcctccctccacaacctttcctctttttcctgcatctctccctctctctcctctcccttttctcccacctctccatctcctctctctctctctcccccgccccccaccttctcttacctcctttctcttcctcattttctgtctctcctgagagcagtgtgatgcctactgtgctgccttgggaggagtcctgtagcaaaaccagtttgggcaatgtgttccactctagcttcaggggtctccagtctctttgcagtacttggtataaattcagagacccaagaaaacaggatcaggtttcaaaggagaggkccagttgtgcaattctagccaaatctcagccccacaccaagttgtggaaaggagaaaaggtggggagggaaggatagtgatggggtgtggggtggttaataggcttctttaatgagaaaaactacagtggtgatattgaggctccagtatctgtcacacacacatacatgcacatacatcatgttcatccacgttgtggttcttaacagaaattgaacagtttattataaaattgaatggaccatgtatttagaaaagtaacttccttccctcctccctccatttattcttctttcctttcatgcttcctttcttcctctcactctttttcacattcgctttcttcctttatctcaaactcttccccatttctacaagctggtccattcagagagagacagttctgattgagagctaagttttaaaaggccaactttggggggcaacaagttcttcacatggctagattaactctttcagccagggagaacttagactgttgtttgttggttgggggtgggggtgcccaaagactggagccaagtatttctagagtctgtgccctgatgagaccccatgtgtagaatatctcattaggtaatgacacagggattcataggtaggatttggaacacagaatgaagctgctcttggccagagaccacagattgctcagatcgctgccataacctcattcaacttccccaacccacaaaggaattagtgcctctcagcacattgattgggaatcactagtctggggaatataactacaaatggaactgctgtgcctaagcatgtgtgtgtctttgactatgccaaatactgcctgactcttctccaaaatattgtccaattcacagccccatcagtgatctaccagagttccagttgctccgtatccttggcagtgcttgagattaccaagacaactttttcctatttttctcatttcaaagggctctgaaattatagacctctgttgttttgttctcataaaatcatgaggcctaaaagcggggaaggctctgaaagatttcctggttctgtgccctcatttgaggatgggaaatctaagttctaagcaagacaagtgactcgcctaaaatcacctaacaagttgggggcaaaaccagcactggaatctagttctcaggaatccagttatctttcctctccatcagaggtttcaaggctggtgttccatagaccatattagtccataaacaatctctctttggcctttattagttatctcctttaattagttgccaacatttaaatatcaggagagttcatattaaaaaacagaattcttcttggaactctttaaagaaatgagaagctttgaaaacatcaggccctccatcctactaggcaaccttggactagagcaaagcgctctgctctttggccaggcacataccctctcctcgacacaccccactcagctcgcttgaaccctgcaggctactgagcttgcatcacctaatcttcaaaacttgcctccataccacaccacaatacactggcgcctagaaatccagggtaaagaaccttttaggatcattcccccaggtgcctcatttctgggtagaaaaatgaggtcctagcatagtagctctttcactgtttcacttcctaagtgaacttgcagaattgatgccaagaacagttttccctccattttctagtgtggagcacttgtcttttttgttgtccccatctgagcaacccagaatgatttataaacagcctttctgtttttatctctgcttccctgtggcataattgcagctaagtggcagggcacagcagttacaccgtgagtcaaggaacagaaccaggagagggacccttgtcagccctttaacttctggctttatccgggttccagcactctccagctatcctctgttatgtgtgactggaatccattcttattgacaatggagacagcagtggggggattggctattggatcagataaggttttacctctacatggaatttgagtccaaaggtaaatatattaaacatatagataagaagaaaagaaaaacgttatttaagtatctgatcagctctgcaccccagggacctccacttttgcccaggtttgagaatttgatctatagaattacctgcattctttcccgctcatccatccaatcagccacctttctcccttcaaagaagtgtcttcatttttttccttcttttgttatttttattgactgcccatcactgttattaaatccttccctctttttttgaatgaagcagcagagccttttattttgttttccttgttttgttttttgtttttgtgtttcagaaatgacagggctgtatcacagagttatttgagacggtcagttagggtaatgtttatcatttttggacagtgtgttcacacaaccttgtccaactaacaggatagcaaagaaaaaagagcagggacttaggggacagactggcagatctctattagaattctttccaagctgagtgcccttgggcaagcaatttaaaactcttagtcctagtttcctgttcttgaaaatgggactaatatcactacctcaaggagttgctgtgtggaatgcaaataaggtgatgtaggtgaaacagagtggccaatgcctgacacatattacctcccttatcccttttcttcctgttttcaagcctgcaggccaggtgcagacagatgtgctgaaaaagcaagatgcctcaatccctgaagtgtattctggaaggcagtagtcctaagaaatgtcccatgaaaaaaaaatgttatcagagtttaaaaaacaatgtgtaccttagccccttctggaaattttcaatgggttatccaaattattgagaagtcctgcaactaagaaaactaactggtttcattaactcaatgctacccctactgatctgaccacgaaatcttttgatcaggtgattcatgggaccaaggaccattttttcttttatagcaaaaagagacagagtagagagactcatcttctcaaggagcttcatagttccaaaagcatttctctcgctctttctctctctcttgccctctctttttttatttttatttttttgttttatttatttatttatttatttattttgatacacagtctcactctgtttcccaggctggagtacagtggtgtaatcttgtctcactgcaacctctgccctccagattcaagtgattcttgtgcttcagcctcccaagtagctgggattataggtgtgcaccaccgctcccagctaatttttttatttttactagagacagggatgcaccatggtggccaggctggtcttgaactcctgacctcaagtgatctatctgcctcagctcccaaagtgctgagattacaggtgtgagccaccacacccgacctcaaagcatttctcatatattggccttactagtctacaaacacaccaagctccatcctgtgctggaattttatacctgctcttccctctgcctgattatacctctgccccaaacctgtgtatggcttatcccttcattttacccaggtagtagtttagatgtcccttcctcatggatccttctatacaaagtgccttgcccctttccaccaactgtcactataatttcaccttggtttaacggcctaactgcatgcatcattatctgaaatgatctcatgtattacttttctttggcacacaccctccctcctgaaatacacaggataacaggcatcttgtttatcccctccgtccactatattcccaatgtatagaacaatgtctggtgctcagtaaagcccccagtgaaggtctgttgaatagacgaatcagtggatgatgtctcaccctgttgacaatcctaagaaacaaattattttattacttccactttacagataaagaaactgaacctcaggatgttatataagtttccaaagtcagacaactgataaatggcagagcaggggctggagcccagatttccctgattggtaaaccttgtgctccttctaccccagaaaacgaagcatttcagatcttcattttcctgtgaagaagaacttaatgtgcacaaaataattggggagggcactatttatactttaatggctctgcaacttaaagaagaaagtcatctttccctctgggtcttcataagagcccaggtaccttctgagcgtgcagagtaagaatgcccaaactgttaggcacaggtcagaacagcttgggagctagtagcttacagagtaaatatatttaaattggaaccatgtggttccttcccctggtgcttacacaatgtgaacagatgcattgtttagtgtcaaagcccttgtgttgactccacagttacagtctctttgaggtctccacatggtacaatgctgaggctgtcaggagtaagaaaaagggcagagaattggagttgtctcaacaagtgttccttaatgccagttgccctgcatttcagaaggagagtattggagaactgcaaagctcccatcagtgagggtctgagacctaaattaaatgcttgtcctttctgggtctttaaaaaagtaaattggtttgtgatatgctttggaagcttttagctccccccgcctccagactttatttctcactatacttttgagcagagggtagagaataggaatagatcccagtaaaaccctcagttgggtatcgtgaaactgagagaaaacaaaaaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatcaacctctttaaagtgtttaagagctattgcaaggcatcatcaccattggtttcctgccatttaggaaacatctgcaaggaatttttattggcactgcaaagtacaccaagatgaaataggcattttctctgccctcaaggacgttctagtccagaaacatgggacaaggttaacaacaaggcctttggagtcacccctctggatgggcacttaaacaagtaacctaatcttgccagtccccaatttacccaactgtaaaatgagtaacgcttagctcatagggttgttgtaaggatggagtgagctcatgtatataagcaatcagcaaatagtaactaatgttattgagtgcttgcctaactataatacaaggggaatgatcatccaagaatgaggatttcatgctgtttctgtttgcatccttaaagattagcctgcaatctgttatgttccactggcactgaggaactgagtttttaatacatcaaacatgaggcaacagcattakagaaagaagggtagaatacccatgagggtgcttgccgagggacacaagagaaagcttcctatggaaatttgcatgatgcttagacctaaagaacgggtggaattcagactggcagaaaggtagaattcagagttgcagcaagatgcaagacatagtctctgtacaactccactaatgatgtgtaagttatcttacagtttataaaagacttctacctccatcacctcagttgagtctcgtggctatatgaggttggccaaatttaagagtataccgaagctcagagatgtgatgtactttgccaactaggtaatagagcataggtatatttacaacatcagctaccacttatttttatttatttatttatttatttatttatttatttatttatttagagatggagtttcactcttgttgcccaggctggagtgcaatggcgcaatctcagctcactgcaacctccacctcccaggttcaagctattctcctgcctcaacctcctgagtagctgggattacaggcgcctgccaccacgcccagctaattttttgtattttcttttttagcagaggtggggttttaccatgttggtcagcctggtctcaaactcctgacctcgtgatctgcccatctcaggctccgaaagtgctgggattacaggcatgagccaccgcgcccagcccagctaccatttactgagtgcttagtatatgccaggagttctgctatgcgtttttttctaaactgatttaattctcaaaatgatccttgtaagtgggaactcacaaaatagaaaaaggcttttgctcaacctggtgcctggtagaaaaatgcaataaatattcactgtaatcatgatgatccctttctcacaaatggaaaaactgaggctattcaaggtttaaatcttgataacatacaaagctttcaagtggcaagatttgaactctggtttgtctgttgtcataacttgtgctcttaatgagaaactttaatcgctgcctctagagtcatcttcaccctagccagcacccctttctgtcctcagtctcaagccccctgaaatcttggagaaagaggctcttagcctttatcttccaactgagcatagctgtcctgtgaggagactccttcttcccctcgtttctttcctccccagctgcgtgcacttcgcatgtgagaaaactgactgtccagagctggctgtggagaatgcttmtctcaattgctccagcagcgaccgctaccacggtgcccagtgtactgtgagctgccggacaggctacgtgctccagatacggcgggatgatgagctgatcaagagccaggtatgtgcaggtgctgagctcagagcctctctgsagcccagggaaggcttactgggtgttaaccatgttctctgctaaatacccagcagcacttaaaatagtgctgccacatagtaggtgctcaataaatatttattgattaaatgaatgcatgaatgaatcaattaaccaagcaagcagtctggaatctctaagaaaaagggttcctgtgcagagtagtgttccacacaatacttaccaatgtttttgtgtaggttgcaaatctccaagaccatggggctgagtattttggaatgaatatcttacagtgagaacataattgaatgggctgctttatgacaaggtgagccctctgtcaatgagatgctcattcattcactaattcattgcaaagcatctgttcactggaaattggatgctatagtaagtactaaagaaaaagaagccattaagacaaatcgagtccttcttctgaaggagcttagtgcctagtggtggaggaagagtcagacaactcattaatgatgaccccactgtgtgataaatgctgtcaagggaattgtagggtgttgtggaggcacagagagattcaagggaggtgccttggaaaagtgacatggaaacagctaactagacagatcagcaaaggggtgtgtgttggggagaaggaagaaatatatgtagtaggcacaggcawggatagtatgtggaagcacaytgatgagaaaaaaaaaaaaaaacatgccacagatttttttgtttgtttgttttctttttctgtactcacccaagcaatgaggctggaagggccagctgaatccactggtgcagggcctgttgatttagtcaggaagtgtggggttgatcttcaggacaacagggagctgttgcaggaaatgacatggtcagatcctggttgacaaagtctcttctagatactccatgtgggtgtagcttggagtctagcagtaagactggtagcagggagaccccctccctcagacagtcatcaaaggagtcatggaagataggacgtgtcctgcgtgagattggtggtagtgaatgatttggagtgatgtgacagaatgttgcttcagcaagatggtgctgtaatgtcccaggtggggcttgggggagtgggacaggttgtcctgggatttgaggatttctgtcactaaatgtagcattttccagggctggtcagtggactttgccttcaaactgcaagcacacagggcacattccttactgctgggaatgcctatttgtacagaacttctggacttgctcttcttagacacctacttccgtgtgtcagacttggcaggcctgaactcctgtagaaacaattagactgttttggcagtgagggacctcactcaagcacacatccctttgatgtgtgcttaagagggaaaatgtcctttgcttttaaaatcccagatcaacgtttggcatctccagtccctaggatttagcggcttcctccttgaatgaaagcctccaggctgcaatgattgtccatcccttgactccgtagcatggtcttgccctccacccagctccaccatcgtgtagtttggttcaaatctccatttactctttcatttttcctaggcttttttttgtctttgtacccttctctcttgactattgagccgccaaatctgagagtagggagtggatctttgagcagttcatgagttcaatccatccattttgccaaagggagaactcaagtraggaaaagggacttgcctgtggtctcataacatggaggaaaaacatggaggtctcctatagccatggagagtgcctactgtgtgccaaacactacaacaagttcctagtaactcctctagagctaataaaagacatacaaatcaacacttgatgtcctaccattgaactgtatttcacagtctgttttgtgaaagaagtcatcatgccctgtgaggtctcaaaacctcaagattctcatcaataaaatggaaatcgtgatctgggaggcactatagacagcagttaagagcatagcctttggactcaagtccaacttatccttttcccagctggttaacttaaggctgatcatgtaatgtctctgagtctcagtctctgtgtctttgagatctgaaatatgtaattcatggagttattgggatcattaaaagtgagctaacgttaaacactaagcattggtctcctagtgcctgggcgagactctgagccgtcaccttgggaagaagggtatttctccacatctagagctcagtctgccactcctcactatgcacgactctgcctttcagacgggacccagcgtcacagtgacctgtacagagggcaagtggaataagcaggtggcctgtgagccagtcgactgcagcatcccagatcaccatcaagtctatgctgcctccttctcctgccctgagggcaccacctttggcagtcaatgttccttccagtgccgtcaccctgcacaattgaaaggtatcaagaacgccttccccagctcagccttcctttgtctatgggaaayctagaagctgcatccaggccctctttctgggtctcaaacaccaagggtgggatgggttttatctatgctcctgacttcttcctactaattgtatttatgtaaactgccctgctatgcagataagaaagaaaaaagagtgtatggataattatgacagtgaagccctttccaagaccttggaaatcttgcaaaaaagaaaagaaagagaggataaaagtgaagaagggagggaagaaggaagagagaaaaagaaaaaaaagttacatttgggactgatgaaactaattcactctgtatgattagggccagtaagccttatgaggtaagcgttactattattcccatttcacagatgaggaaaccaagcctcagagggtttaaagaacttgcccaaggctgcaccatcagtggtggggaccatattgaaacccaggtctgttgttctccaatgctggctgccactcattaagaggggccagctgggcagagaagagcagatatggacaggaagcatctggcatcctcctgagctaggcaccagggctattgaggggaaaaagacactggcataccagagaagaggtcacattttagaaaaaagtgagtagctggcctgggtgtcctagaatgctgggactagatgtggaatgtgttaataactccagactaggaaatcatacttctctcaatcaatcagaggcttttgggaaagggaggtgtataaattaacattgattattacagacctcattgtggctaataataatacttaatcaaaatgatgcagatccttccactgccaactgttgttggggaagtgtgacctggctggggagacaaggccttaggaggaccatcattttgacagttggtgatcccaactttgcttttcctttgaccatwcagggaaatatctctctatttccatattgatcaactaggaccaattgccacttcatgcaacttggttgtcagcatcatctagtgttcagagtactgtgctgaggcttctgcttggatctactggcagcaaggactgggcaaaggtcctgctgcctttctcttgaacttgatattgccacctaatttgccctcccaccctcatctcaagccagggggtaaagaggtgatcaatttcaactttccttcttttacttgcttcccttttctcctttctaccttttgtttttcctttgatcataacatagtttaagcaaaaaggacaacagtttttttaaaaaaaacttttattttaagttcaggaggacatgtgcaggtttgttatataggtaaatttgtgtcatggaggttcattgtacagattattttatcacccagttatgaagcctgccttaataccctttagccatttttcctgatctcctacctcctcccatcctcttccctgtgataggccccagtgttagttgttctcctctatgtgtccatgtgttctcattatttagctctcatttataagtgagaagatgcagtatttgtttttttgttcctgcattagtttgctaaggatgatggcctccagttccatccatgttcctgcaaaggatatgatctcattcttttttatggccacatagtatttcatggtgtatatgtaccacattttctttattcagtctatcattgataggcatttaggttgattccatgtctttactattggaaatagtaaaagcactaattttaaacagkcaataaataataatgataayaatgaccagcttgaaatcctttctgccctcagtttttgccccacctggccctctcctctatttgtacctcttgtccttcttaatctgtcttcttcctctgtacttccgttaaagtctaccccttaccaagtctacccccctgctccttgcaatccccccgtaccagcccttggctaatgcagccagttgattgagtgattgtccttattccagtccagctagtgcatttttgtttcctccaaacaatatagtggccaatattctttcacattctaacatgctagagatggacaagaactcagagacagctttggtttagggacaaacaagttaggtgatttgttcaaggtcacagataaattcatactttatgcattcaacaaatggataccgaggacctactattcgctcagcagtaggctaggctctgggagtaacgaatatacaagatacagcccttgccttaggatctagaaagtgccaacaccatgaggcaagtgcttagaataccagattgaaggtctagtatttctctccttgagttctgttctatgttaattttaatctttacagcactcccaaagagacttgatctcctgggtaatcttttaaatgaagtaataaaaataagtacctctcctttgacactgctacaagttgacaattgttttaatgctcattagagattggaatttccttacccacatttgtagacaggctgggcaggatgtatttttctgcattaaaagatgaacaagtgaacttacagggtcccaaaacttgacggacccaaaacttgatggaatctaatctctaatatcaacacctctatgaagagacgttaccctctaccaggaacttcaggctcagacatgccttcacttcgtgtcttgagtcatgttcccccaggaaatacggtgggggaatgaggacaggagacatggaactgacaaaagtcaacaggctctcttctaaagcaagttgccactgtgggcaactagagctcagtccctctgggaaactctgggagacggtggagaacatgcctccgagttattgcaactctggaaactggcacatgaatccaacaactccrccattagtttagtggtgcttccaggggcattaactccttggtactttaaactcaccctgcatatggacagagtaagcatcaatgaccagtataataagcatccatgagcagtataatagccctcaggcagagagttggcagtgcagtaagcatctttcacagtatacaggccagtgccaagaagacaaacgaagggcacatcatgtatcataccctactttcttcaaagccacattgtagatgcagggtagtggctacagctggtgcacagaaatactgcccagttgaaaactctcttggagtttgttgcaggggtggggggacatatccatggtcctgaatcaccagtgcctgctttagctgtggtgcactgctaacttctattcaccctcttccagaaagcacatttctggtttgcattttctctcttgattaacattttggaaactttatgttctcttgtcacagaaaaccacgactttcacttcataatttacmatatacatagctaatacaatgtactttttaagagtcccaacaccttttccacagatatgttatctctcttaggcaatttggagagggtgtgcttcctgtactttatatacagctccccttcccactaaccttgtgcattagctgggcaccccaaagcaatgactgccccgattacaagggcaatgcaaaaagaagtttgtagacactgactggtattctggacgcttctatgcttctatggaaaccaaatgaatcacctttctgcacactttactctttttacttgatgttaaaatatatatagttgtcagtctcacagtttgtcaatgtggaatcccctatggggtttacagacaccaatctgccttgtgctaaccagatgaatcatactgacaaagaagaaaaatgaaaaaaatgagaaggaataagataagtggaggagcgtacataaaattgcaaagtactttctcccctttcttccttttcctgctttttcttatagtacttggcaccttctggcacactaaataatatactttttaggataatttattgtactcctccctgtcccactagattataagcatcaagagaacagagctatttctatcttgttttgttttattttgttcactgctttgccttcaacatataaaagtatctggtgcagaataagcactaaatagatatttgttgaatgaatgaagacttctgtgaagattctttcagagctactaatgaagatgaaaagaagaaggaaagtgggaggaagcagggaagtgaagaaaggaaaggagggaagaaggaaagaagttaagaagcaaacgaagacattgacaacacttttataggcacttttcataaatgttgttttatttcatcttctcagcaccctgaaaggcagaagcaattgtttgctttccacagatagaaaaattgagatttgatggctccggaatgaataataagggccctgctgatcatacgtagtagccaacttcccattaaaaacaaccatctctgtagttagacagaatttgttttgaacctcagttttgtcttttgccaactatgataacttggtcaagtcacctctttctgagtcttcatttccaaataaagactgtcatactaaatgcactgtttatagtgagaataaatgagattgcatatcagaagcactcggtacatagtaactgcccagtagatgtcagttttctccctaccactccacctctccaacctgcaagtccccgagcccccgacatgtttccagccctgattgtcaacaccattcagtaataaccaggaaaaggagagtttggtggagaaacacaagtttcaggtcctcctctagttgtcttgggaaggttttaggcgggctgtgcctcgataatatatgagctggcagtgaaaagcctaactcccgtgttttacttttatttgcaacgttccccatcagaccagcttcccaatggcagtcagcactctgtcagagctggcatgggctacgggggaagtgctgctctttcacctgctttggcaaagcttcactgagcaccaggacctgaacagaaaatcaaatctcctaacacaatgctgtcacttccaggcattggtggtgggagctgggggaggtggtaggcaggacagatacaggggtgctgggcccagggggagagtggcagcttgaggtcatgcactcactgatatcagaatttgctgtagtttctggtgggagtttttgctgccaagtattagaaggcaagtgcctccatctctgtgctcagatgcccatttgtaaagtaagaaaaatggattcaaggattgtgagtgtgtcttttctatgcagcagaagaggctcaggatcagaagtcagaagccttggattttaattcactgtagacatgggggtaattcactccccccatttagatctcctcttctttgtggcagctctcttgatttccctaggctcctcagttggaagtagaaggggttggaattccacataagggatctcctggttcttcaagtcagctaaaatccaagtagctatacattagcttggctatcagagactcctccctcctctaaccctgcttgcctatgtcttccaggcaacaacagcctcctgacctgcatggaggatgggctgtggtccttcccagaggccctgtgtgagctcatgtgcctcgctccaccccctgtgcccaatgcagacctccagaccgcccggtgycgagagaataagcacaaggtgggctccttctgcaaatacaaatgcaagcctggataccatgtgcctggatcctctcggaagtcaaagaagtaagtggggttggaaatgcaaacttatggtctctgggaggacaagagttaggttcaaatgcctgactggacggaagcactcatttcttcactggaggtaatgactgccattcatcccattctgttctgtgagaagctagaaggatttgttaataatattagctttgggtcaaacagaacaaactttaagtttcagcttggctgcctaatggcaatgtgatctcagacaaatgactttacttctctgcacttcattttttttttaagccacaagaggggtatgataataacagttaccacgtaaggttgttatgaagaacaaatgaagatgtgcaygtaaagtgctcacaaaatgctttgcacgtagtagttgttcagtaaatggtgggtaatcataacatgatggttccaacacacatcagaacactctgcaaaaaaggggagagaacctggggctgaagggcatgagttttgtctcaatctacatgtagctggaagcatgacatttctgcctgctcttgctaaaggagttctgtggatgaattatccttaattcctgcacgggtcccaccagaacccaataggtcaggtggggaatcaaaactaggaaataggaaatgggggcccagctggtggtgttcatgcagggcatggatctagccatttggtccttgagatgtctcctgtttgatcctttccttgaagacgggccttcaagactcagtgtaccmaggatggcagctggcaggagggagcttgtgttcctgtgacctgtgacccacctccaccaaaattccatgggctctaccagtgtactaatggcttccagttcaacagtgagtgtaggatcaagtgtgaagacagtgatgcctcccaggtaagcctcctggaacttgagattgataccatggtccctttcctttctgcttaccaaaaactagcctgtacttcaggaaccactttctgcacttttgtaatctctgatcctcattttcctacccgcaatactgtttttgatttgctcagagattcttagctttgaatttttttttaagcattggaacttttatgaaggaaatcatacatggaatcccaatgtatgaagttgataaaagttaagttcctcaaacaggaaatgaccagggctcttttcccagtttgctacctccattaccacccatgttggtccttgaagtatttaaaatcacaagactgcaactatatttagacatcaattggctcctgaagcataaggaaaaaggggaccatatttagatgagaagtacagttttgagaacaccatggaagaaaggaagagcagaaggagcaaggtttgaattttatctcaatccacatgtaactgagaacaagtccaacactcctgcctgcctctgctgaaggaattttcttcaaatcctacacatgcccaaaaggatggtacgggaatcaagaataggaaaaaggaacaaaaggctgaaaaaaccttaagtccacaaggagctccatctccatcaaagcaaccatgcagagttgataacccaagtcctgtgtttcacaggtgtgcaaggatcatcagccaggtggggatagatttcagtgcaggcgtcgtcttcaatcagtctttattggtctttattgttagcctccagataccaggcactgccaaatcaccattctgaatccctctcactccctccatatccaagcaattactgagtcatacccattctcccacaacagcatctcctgaagctgttctcttttgtccccaatgccactaccctcactcaggccaacatcaactctttgatgagccaccatgcagcttcgtgatcattttcctgttttaattcctgtgcctctttccagtacattcttcacatttcagccagagtgatttgagcaattatgtcaatctctctgaaccaggagcccccgtcccttaggataaagtcccaactccttagggtgacatttaagacccttcccccatgccaataagatggattttccccccacacctctgcattctctaccttaaaaagagttatccttgtacctttttcagctgtctgacacctcatcttccttcgcaatttagcccaggcaccctttcctgcaggagcccttcctcaatatcccttccactgccgggctccgtgcccctcctcaggttcccccttcacaacattggccacactgcgttgtcactgcctgctttcattccacatccccacactaggctgtgaaacagtccttcactgcatctgcacccttccctgtgccttcagcacttaggacagtgccaggcacctagtaggtactcaggaaatgtcacaggaattaagggcaggaggaaggactgcaatgaacatcaaaggcaggttcctccttttacagatgagaaaaccaagactcaaagaggttactcaaccccccatggtgacacagctggcatcggctgagtcacagtcagaatccaggttcccctgtctccagctgtaaatgggctgagtccagtaggcaccacctgagaatcctgttctcatacactctcggcgtctgtttgcattcatgggagtcattcccatccttgactgccagggaggcagaagccagtaccggaacaaacaaaggctagagattaccacggcctcttgcaggctgatcagcttccccctcactcccttacataaaactgttgctaacagttacccaaactgctgagccaaataatattctggctgcggtcatgttatcaaactgaaactcagcctgcctggggccttccaagtaactttcatggccagtttgtatttaaaggagaggaaagtgtaaatgtatcagacgactcaagcagctctgtttggcaactaacggagaggctagtcgcaaaggagcagggtattgcttgtctgctcaaagaatgagggtgtgcgtgccaaatggactcctaatacaattgacgtttctactttgtactgaaaatgaatttcctctaccctcagatcagggcctgagagccaaatctagtattcacctcagattccctcttgctgcctataaacatagcagaaatgcatggcccagagcatcttgaatcagcttgtatggagcagggattctttgctttccaaacaagtttcagatcctggcgggaaaggataggggctgttgtaggggagagtcacacactctcttccactgccactaaaagcaaataaaaacctgactttattcattccttgggagccagtatgacactggatctgtagtttgagttcaaatcccagctttattacctagtcactagaggccaagttacttaactcgttaagcttcacttttcttgtgtataaaatgaggagaaagaatactacatacctaatagtttgtttgtgaaggttaaatgaggtaatgaaaatagagcatgtctatgggtacccactggccttgtgcagtgcacaacctgtgcaatcatatgtggtagccctggggaatacacaaatgaactagcctgctttaaggtcactccagtggcgagaatcccttatgctctatgtgagctcctggagggtctagaaacacaacagattgcaacctagccctctgctggctagctctaaaaactgagaagttttctgttttctgcatatggctagccagttttcccagcaccatttattaaatagggaatcttttccccatttcttgtttttgtcagatttgtcaaagatcagatggttgtacatgtgtggtgttatatctgaggactctgttctgttccattggtctatatatctgttttggtaccagtaccatgctgttttggtttctgtagccttgtagtgtagttttaagtcaggtagtggaatgcctccagctgtgttctttttgcttaggattgtcttggctatatgggctctttttggcttaaaacctagatgacagtttgataggtgcagcaaaccaccatggcacctgtatacccatgtaacaaacctgcacgttctgcacatgtatcccagaacttaaagtaaacaaagcaaaataaaaacaaaacctgagaaggaggcacccatcctgcatgaggccaggatgtggagtagagagaccagcatgagctttagtcaaacctggtcccttgctcaaataaacctgtagaataaatagtcctctagttcctgtagaccagcactttccagtagaactttctgccatgataaaaatattcatatctgtgccaggcaaatgatgaccactagctgaatgtagctatggagcacttgaaacatggttgcagcaaatgagcaacaaaatgttaacttttatttaatttraagtaattcaaagttgaaggcaaatagccatacttatacagtggctaccatatcagatagtccagctctagcacttacggtattctcgtctctttaaaccatgacagagaaccttaataataacagctttctttgtctttgtttttgagtgtcaaatgtgtgccaagctgctgctgcagacttgctctcttttgacagctcacaacatacagctggaaaagaaacaaaatccccattttacagatgcagaaagaaggcccggggagggtaagttcttgcccatggtgacaagagagcaggtgatgttctttctgatctctagctctgctctttccactgctcccaaacatcttcaggccagaccagtagtgaagggcagagattttatccccagggggtgagaagctactcatctcaggatttaatccagctcagatggccctgagctagttgatgagataacataggcctgtgggggctttataggtgagtcagggagtggccagtcttgggatggggacggggtctttggaagatgcatcagcaggggaggacaaaagctagaggtgctttgtgggcaaagtgatgcacctaatgatggatttcagcaactcagcaggagcaagagagaaagggagcggtggaatctwcaacacacccagctcattgcacagatcacagaaggtggctgtgaaagcctttctgccataaggggtgtagagctgcactctccatttgtgagccctgccatggacaaggtacagctcacatatgtgcagtgcctcagctaggttttcatttccgggttgttaaatgtttggccaagcacccaggatgtcctagaggaattcagaagagtcacagacccatgtgatgttagagctaggcaggacctcagagacccccactgtagcttgcttgttttactgatgggagccctaaaccccagaaagggaaagagacttatcctgagtcatacaagcagagccagttcttaaactacgtcactttgcaattcacactttccactcatcctcccttgtggggcaacatgtcacccctgtaccaaccttggaagacacaaaatgcatgtgagggcattgactgggaacagagacaaatgattcacagcagttgaaataatgagcacttactacatgccagccactgagatgagcacgttagattgattgcttcatttaagccccatggcatctggcattattgccccattttacagatggggaagctggtgtaaactggtttgccctgttttatacaaccagacatggtggaactgacactcttgtttttaagtcagcatgcctccaaagcttagccatctagctcctgcactcactgcctggttttgtcttgctcggatgccactacatttctttccgctattattttgtttattttcatgtcttctaaggagaagaagtctacygcttctccctcttccttcctcttctcttctttcccttcatcccactggggtacaacagcttacagtcaagagacatggttctgacattggcaacctttgtgacttgggcacattgcctcccctttctggctgctgtcagttccaaaatgtactgttggttgggttgattctaaacttctcttagagacagtacagcaaagtgagtaagaacctcatctgacgattacagagctcagtatgtgttaggctttaaatgctttatataattggactcacatgatcctcatgatcactctctcaggtagtagactccatgcccatttagcagtcagggaacttgaggcatagagaagttaaagagcatccccaaatctacccagctgggaagttgccaagcttgcatttgaattcaggcagtttgacttacacccaggctcttaaccatgacactagcatcatttgaaaactcactttttcactttctaacagagtcagtttccaagtctgcaaaaataatataatttctactctactgtattgttcaagtgatttttaaagcactgggcatgttataggtgtttgataatattattatatgccttcagctctccgtggatctgtgtagctaaagcagcaggggagttagagctcaatatgcgcttgtaaaaacagatgcacaggcacagagaggcaaactgttttgctgagagattttcagccctcttataagagatttcaccttagcatgaagaattgtacaactggagtcaaacatacccagtcagttccctgacaacacctagaaaaagtaccctctggtcttcccaggttggagcttcagtgatgccagatcttctctggtcaaaccagactcagtcagcaataattgactatgaatttctgcaccaggtggtaggcaatttctgaatgcactagcatctagtcttaaagaaggatttaaaaatccaaagaggctccagaaagtctgcatgcagagggcacagcaagggcaaagatgtggaggtgggaaagcaagaaaagtttgcaggagaaacaaagtgattcatttgtctagcaggaaggatacatacatagcaagagatggagctagaaatgtcatctggattccattgtagaagccctgaagtgccaacctaccagtatgccttgttctgaaggctaaagtgtcttagcaaaaggatgctatatatttttaaaagcaaattttgcaacacaaagtgccagatgaactgggcaggagagagataaaccaatgataacaaaaccagtgctttatgctcccacctttcattcatggtggggcctccccagtgtgaaactccatgagcagactcyggctacttctaatacattctctgttacaaaccaagctctccagccagccctggcccaagtagtgctgaggtctgcagccctttaggggytggaatccaaatgcatcacaggcccaggccaaggctccaggaaattggggtcaatttcctactccccagagggcccaggagaatcatggggcctagagcctggggctctgagaaggagagtctgggctctttgaagccacatgaagctgcgtaagtttgccacgagcccctacagaacctctgggagtgaactctgcaagccgccttgcagctgcatgctcaggatgggccacccttctcccaaggccagagaggtttccattgcaattgtaccctccttttgccggcaaaggagaggcctggaaaggggcccctttctcttctgaatcttgtctatctgcagctgttttctcacataggggagcctcagcctacatcagttcttttaaggagtttattcattttctcatacattcattcataatttattccctcattcattcttttcttcatttactcacttgtgcatttatttcctcatctgtgtgttcatttattttcttatttcttaaagaaatacattctatcactctccaccaattcaccccatcttttcgtaaacaaacaattcttgaatgagcaaaaatatctattaagtgatgaatgaatgcactgagtggcctggaccttttaggcattgtggaaaaccctgaggatacaaggttgaatagggcaccagcctgggccttgaggagctcattgtctggttgcaaaacagatgataaacaaataggtaatgtcctgtcagagacattcaggtagtgccccatgcagaattgagatggcaggagagcaggatgggttgtgccagataaggtatttgcaaggtagacaagggtgggtaggaaacaatagcagacagaaggagcagtgagcatgaaagcacaacatacgatgccttcacaaatgcaggcaatttaaactgaagttcaaggttggtggtggtgctctggagagcaagaaactggagaattaggcagaattaaggctgggagggctctggagccagcacaggagtttgcatggaagctgaaggtcacaggaagccattgcataaatttttgcattggtggagcacagccagctcctctggcctcatgtcaagtttctcatcttattataagcctgaaaggggtagagaatatatagcttgttcttagatccttcacaatatgggccccctgcacagaaaccacctgtgattctccatttctgttcggtaaagtctaaactacttaagttggcatttaaggctccacgctttatctgtgttaccagctcatcttcccctgcttcatgccttgagtcatagaattagaaccacaacaggctctccagcacacacgatatttttcatcatttgcacacgcccttccatcttccaggaatatcttctgttccttttctgcctgcaattccatgcatccttgaaaacccttttccatatatcatctcctctaagaggccttccctgattgtcccctcataaccagttactcttccttgtgtactcacagcactggtgtgatatttgccctgcctcactgaacacagtcacactgacatggctggtggatcacatgactgccattcccactagatcgcagaggcaggcactggctctcttcacttctgcaccccacagagctgggcacagattggacactaacgaatcttacttgaattagctttctgaaattcggaggttggaaggggacgtcaagaagggattatgtcttcaagctgcatttgcctaatgctttgcagaagattgagaaactataattccctattttaaagaattgggaggaaagcacagatatataagtatccccatatcaccctcttcatgccattattgttggaatggaatgaaatggaatagaatggaatggaatgaaagaaagagaagatgagaaaaggaaaagaaatgtcttggaaaaaaagcttctcagctagacccagattattatttatgacagagccctgacataggatactttctcactatttaagaggaagtaaactttagtgttcctcattaacccatgctgctactctctgtgtcattcaaggagctgatgggctcctaccctctcaatttaaaaaaaaaactcccacacacaaatcaaaactataattggctctgattgaaatttctgaaagactactaagctcggacttgggagtttggcattctggaaagccttgaacaagtttcttcctggtctgagtcctcagtttccccatatgtaaaatggagacactaacaatacccctctttcagggtggttgagtttcaaccattgttaagaaattgttttggaacacttcagagctctggagagatgaaaaattcttttctgttgtattcagaatagcttattcaattggggctggtgtctctcttggtcctaactctgtttctctgttgttcagggacttgggagcaatgtcattcattgccggaaagatggcacctggaacggctccttccatgtctgccaggagatgcaaggccagtgctcggttccaaacgagctcaacagcaacctcaaactgcagtgccctgatggctatgccataggtatgatgggcccgagaggggagcagtaggaggggcaattccttcmmgcaatgcagggctaatrcctgggtgggtcattgaacaccctggccacatgagttcctgcgtaggcactacagaaagagagatgaattagtgtagaccatgtcctcccagaaagagggtcagggacagggatatggtgacacaatggtgggtgagtgtgcacagttacaacagaatacagaaaagctgtcaggtgcctggtggggacacagaagactcccacaggaagggatgcttacttggggatttgaaaaagcttgtcggggaagaaatgctattgcaggcagaagaaactctgtggctgaggagcaggagttatgaaagcacacatcacatttagggaagcaatagcagtctggtgcagcttcttttattattaatcttgwaatttgcatcatactaaacattcatgagtacctgatatagttcaggcccttcatcaagcacttgaaaggcattatatcttatcctcacaataacctttaacagatgagggaatcaaaacttgaggggataatggaacatgctcccaaatcctgagacccatcctattccaaagtctgacttctttccatggcatctcagctgcatccaagatgagcataaactgcattttcaaaatactctttgcatggtgacaggccagctcgagaaatacacacagtgagaagagacaagctgggattgtatgccagggatttgcctcgttgaaaccaggtgtctggacacatgcattaatcaccagcaccacagctttccggggtactcagagtgcatggagtgtgacctcatttaagggcagtgatgctgaccttttgggctgattccctaattgaccatgatgaaaagcctagggaactgaacatcctttctcctggccaatatgatttayagagcaatcaccaggggtgtctggtgtagaaggttatctgaatgtgcatagagccaacatgatcttcatccagcaaacagagagttatcactgcatgtccagaagcaaggcctgtgtggttggagagggaaggttcatggggactgtccatccttttttgaagatgaaaacacatgccctcagatagcagaagttcttcactgtaacttacagtgggaatcagcactcttgtgtttagcccaggacactggctcctgcatgggtcagaaaacaccaaaacacatgattgctctcgctgatggtttggaaggtactttaagatcttatacagccaccaattcatgagatgctgaccaggagtgttgcagagagatgggatcttataggacctgctaatataggcattctagaaggttgggcaacaagtattgccatggtgagcagcatgggctgcaccatcccaaggccaacactttctcctttccatcattcctgataggtgtgcgtggtcctgaacaagtatgtctgtgatggggtcccaacctccagctcaatcagaatatgcaagtgaatattcattcatactcttaactggcattgagtggctctgtgagaaaaagcctaattaagtgacctttagggaaaacctacagaaacaaatttgctgcatatctatacccactgacacattcaaatacattcacacgtgcatacataaacgcatgccacatgctgaaatgcttcataaacaaacagccccaaacacacacatcatatagtaagctcatgcctaacacctacacatcagccaaataccacacaaatgcatcactctcacaaacacatacacacacaggtagcacataaacctatacacagcactcacatgcaatacatacaaatctcatacttcaacaaacacaaacacattttatgtcccaaaacatatcaaacacacagaaagacgcacaaaaggcaaacaaacctcacagacgcatttacatattttattcasatgtctcaactgtacgcaaatgagtacgatacctggctgtcttctctccatcagaacagtggagaaagaggggaaggggtgggagggtggtatttctttacccactgagtgttttcatggtcaaagcagaaagggaaagaaatctatatgatattgcagcctgaattaactcctttcctgtaccccaagtccccacggctggcacccagatgtccatcttataaatgtgataatccagggcagatgatgagtgcatagggacactggaggagatcagagagaaaaagccacatagggagacaggaagactgagggtgagaatgagaaacaaggcaggagagcagtttttgctcatccactcctcagccccagctgtatcctcgctttcctccaaatgcgcctgacttccacctcccaggctgagcccttccctgaggagaatccactttgccaaggagagggatttgatcactggccttataagcaggggtgagatatgtgtcgggcttgggggctggagggcacattctggagtcacccagaccagctccccctgcgtgcctcccccaggccacctggggaggcttctgtggcagttatgagccctcagaaagttgctgctgctgccaccagggctgccaccctccccgcgcctcccgggaaggagacgcggaggcctggtgagatcaccactctgtaaggatgccaataatggctcatatatcacaacacagcagcctggtcctaaagccccagagctggggtaggggaggagagcctgggggagggagacgcggagaaagagaaattaagacatgaccgctgcataggacagcaagtgtctcctgttttgaccaccgttttttttttttttttyctctcttgggataagatagcctttgtctatttctcagaggctgcatttttttttttcaaaaggattttattatcacagccttgtctcatctttgctccctaaaaactcctttaraactggtctcatgataaagcacactccataagcagtttctctgactgcttagggatttttgctccttattctcatcactcatcatttttgtctgtgttatccccatttcttgtctctcctctggcctctcaccatctctcctgtttcgatggctgcctccttctctcctctctctgtgtggctgcactgttatcgattgtggggcctggaattagagatgtggctctctcctcaccagctttgtgccctgagctttgtgccttttggctctccaacctgtgaaacgggtgtcatgtacatatgtatatttggaagggggcctctgaaatagctaatacatacatatgtatatttggaaggggggactttaaaatagctaatagaataggatatttaaagaaaagagttgacttgctcctagtgtttggagggtggtttcgatactaagagaaatggcctctttcaggcctagtcagattctgacaggttgtttctttgcccacatgaataaatgcctctttggggtactgagtactttccatggactaggcttgatttttcagatgacctcaggatgtgtgaggtcagggtagagaatgaatgagctgaattacrgtcaacttgccaacccacagcctggaagtcaactgtcttcacccaaaagttcctggaccaagggcttctatgtagtagccctatctctattagtcatttaccccttctttgactcattacctgattttttttattcctttatccatttaatccataactcactcattcacttatccatttatgtacttacttcttccttcatacgacacctaaatgcatattcatcagtcagtcatcatgccattcatttatccattaatccactcatttcctgatccattgatgtacttattcactcactgtctcttgcactcattttacaaatacttattgggtgcctataatctgccatgcacagtgccaagctctggacatagaatggggagcatgggtagtgctggccctatagagttacagtccagcagggaagagagctattgatatcacactcaccaagcaaacaggaaatgatcatgtgacaattctgtcatgggcacctaggaggggcttggcctgtcaggaaaccatgaaggtcttctctgagcaagtggcttgggattgaggtctgtaagatcattaaaaatgcacttgttggagtgggaagggtctttaaggcacagggaaaggcagggatgaaaccctggggcaagagaagctggtattgcatttatgtgctcatcattcactcggccagtgctcactgagctctacctgggtgtcacacgctgggttaaactccgagatgaatcaagcacatctgatgatggagtactctcactcagttgtggaattcagggcaaacttcttagaagaattgaactggcccttgaataatggatagaattcggttatgggaaggcagattgggggacatttcaggagatgggatgaacaagagaagaagcacagaggatgagaattgtgggactcagatggaaaaccaagtgtagttcagtccggttgaaccaaccaaagagtgaaggtggttagtgagagaggagattgaccagaccgcaggaggcactgagtgcccagcaaagggggctgtattttgttctggatgtggggagccttggaaaggtgtttgagcagaggaggagcttgatcaaactagggtcagagccaatgagtgtggcagcaggaaccagtcagatgggaggcatgtgaatggagtcagggagaacagaggtggccctgcctggcttgccttctccttcccactgccttcaggttgggtagctgagtccaccggggaccagggagtgggagggcccactctgcaggagggcagtttgcagatgttgagggtctcgggcctgagctgcgcctcatgctgtacttccctcagggtcggagtgtgccacctcgtgcctggaccacaacagcgagtccatcatcctgccaatgaacgtgaccgtgcgtgacatcccccactggctgaaccccacacgggtrgaggtgagtgaccagggacatctacccacctgcagctaagggggagggaaatgatattgttgagcacttgctatgtcccggtyctgagttcattctttcacacatattacctcatttaatcatcacacctgccctgtgggtgtgtgttgcagggaggtggggtagagtcgggaggagacttattcacartcatttctctagtccttaattatttaatactttctctctgtcaggtcctatgtgaagggccttttatttactgtccactaaatgctgatgtcagcctaggaataaactgaggcaccaataacagaggtagggagcatagagccaggtttcagacctgagtctgtctggctggaaagtccatactcataaggatggtgttgtatggcttctctggtgccctcccatgtagccttccactttacatagcctaggtttctggtatccttctccaagctttacctgttttggggaaagcaattaataggtgtctagcaaactagtaacatcggttgtttgtggagaacctgccacgttcatgtgtycggtgcttagcacgaagactccattttagcctcagcacagttgtaygagagaagggtcattgtctgcattttccagttgtggacactgaaatctcggaagtgaggtgatgggccctgaaccaaggcttgaacccaaacctgagtctgagccctgtgtgcttcccacagtgccaggccggtgtgcccccagccagatgactacagaggccccctcctcagggcagtgtcagtttgacttcaaggttggctgttcccactcgcctttgtgtcacccaatcaactggggcccccagagctgatgtgggccctgcttttctcccccaggacatcgcaggtcccaggccttatgtgtcactctgggcactggctcttcaccctggagaaaccgaaagaaggaggccggggttgcggggtgggcgaggttcagctctgtgtctctccaaccagcctactgcctggggtgctgagaggccatggagcccagggagctactgtctgcctgcctgctgcagatcacactctggatagctgggcagaacctgatactgggtgtactgtttctcaaatgcgctgagggcacgattgccagggcttactcagcactccgagtgtatagacctggccagacctcctccactcctctgtgcgccccggcatgctcctccactcctttctgcttcctctttctcttttgctgtctctttttctgtcttcatcttactctcactaatttttttcctatctctgtttttccactctgtttctctctcctccctcttctgatatacctttcctcttgttctgtcttcctctctcccacactctcctttccatcatccactgtttctctctctctctctctgcctctgactctctgcatatctacaagacagccctatttcccaaacctcaagctctttcatctgtttcctccaccattcctgaaccagaattcctgcacagattcccccgagtgccccagtgcaccctgatatgctcatatacccagrcatgcagggagcccacatgtcagaatctcaaggcagctagagataatcaaggacaggttcctcattgtacagatagggaaactgaggcctatagaggaaggyggctggtccacacaggcagcacaactggaacgacaagctggacttgtgattggcagctcttccaatactaccagctctccttccttttcccacccgaactcccacatacccgaaagcaggtgagtttgactcacacacaaaacagacacaggagacctccctctcaccccagtatcagagatcttcttggcctggaccagcctcccacttaagacctttttcctaccccctgggcaaattcccacccttccctctgtgggccctgggcactaaagagttcagttatgattcactgtgaaataaatccagggatttgaaagcctgcaagctgccccccctccccaccattgcccacccgctgcctgcctgccccatcccccaacccagttccctggtctgcctgcctttattgatgctggcctaccgagagaaccataatgaggttcagacctccactggtctctggaggcctcattatccaggaggaaaaaaatgtggtagaaaaagggaggagggcgaagggcagagattgatgatttccaggaataagrcagaaaagctggcctctgctgcacccttgccccttgtgcggtgagagctacagaaatagagctgctggtgccagcatttccaggccagaggaggccctggatagctcctctgctttctgagggtctgcctgcgagcaccagtgcaatttagatagctgggggtgaggctctgctccagctgctgccacttttatccccggggtaagagagtgagaggcaagaactggcatttattgggcacttgctgtgatcaggcactgggtcaggcacttcctatcctttatttccacctccaccccctaccacacacgtacgaccacacacatatgtccctatcaggtgggtattagtctcttcctgcttccagtggaagtaatggaatctcagaggtggaagccacttgcctaagagaaggtgaagagagacccaggccagtctgatagtttacttcagctatccctgcagcctctatgaaatgtagagtaataaaggcaatacatttagtgatggcttaccagggatgtgctggcaaatagttaacaactggctctccacaaacattagactctgctttgtagcatttcccaatttctgtgatataaatattcctaccgtggcagatttcaaggtttccaggttgctgtcactgagcacaaagttgggaagatccaggcactgctggctcttgcgagcctatgcaagccagctgtggtccaccaccgacacttagccaagacagactctattttaagtcctttgcatatattgacatgaatgaagagaaagatgactgcttagatgagtggaatgtcaacactgagatcacaggtcatgatgtggacaccaggacagtgagctttgtgaaggcaggaccacggtcatattagttaccatagtacctcccttggtgcctagcacacagcaggtacttgctaaatatttatgattgctgagtcagatgacccaggttctagtgtaagctctggtgccttcctgctgtatgtcctggagcaaatcctgtcacttctctaggccacagtttacccagttgtgaagtgagagctaggcttcactcaggagtcacaaactgaaatgccacctgaaccaggcaggtggagaaatgagtgaagcaggccaaacatactcttttgtatattaaatactgaggcagccgggcgcggtggctcacgcctgtaatcccagcacattgtgaggccaaggcagaggcaggtgaatcacctgaggtcaggagttcgagaccagcctggccaacatggtgaaaccccgtctctactaaaaatacaaaaattaggcgagcatggtggcgcacacctgtaatcccagctactcgggaagctgagacaggagaatcgcttgaacccaggaggcggaggttgcagtgagctgagattgtgccactgcattccagcctaggcaacagagtgagactctgtctcgaataataataatgataattaaaaataaacactgaggcatattagtagtagtagtatttactgtaaatattttggaaagaaagacttgcagaaaaatataacacccatacacatactacccaacttaataaataaaaactttacagatactgttgaagttcttttctacttttctttttttcaattttttatttttatttttttttagtggagatgaggtctcactgtgttgcccaggctggttttgaactcctgtcctcaagtgatccttctgcctcagcctccttcttttttattgagctataacttacttctttaagtgtaaggcattataaattgttttgggtacactcatgaaaccactactcatattaggatgtggacctgtccaaatcttcagggagtcctccctccccaggccaggcaatttctccagcaccaaggtaaccactgttttgttctctattgctatggattggttttgcttatttgtaaatttatytgtagacttggtccctatcactacgaattggttttgcttatttgtaaacttcatataattagaaatcatgaggcattttcataagtgtgttttcaacttctataaagagaaacacaatgtaccttcttttttgtgtcctaaaccttctttttctcagtccccttccctgtacatgcacttttcaaagtgattagaggtacagagaactcttcctctaatctaataaacaaaatgatacaaactcaataataggtggaaatgcccctcaggttcaatgctagagagaaactgcagggaatggtggggactatggcaaactatggaaaacacagttgttgtttttctgcttccaaagggggacagcattagccaagtgcagcaatgtggaaatgtgggcctcctgtggccaaatttttcattttttcttgggtacaagaaatctggagttcttaaaatttgaaatctctttctttttttaaaaagtttggcaactaattttgactttttttaaacacttgtatgccaaacaaaacatttctgtggtttgtgtagcctagaagctgttggcttgcaacctttggatgagatagactattccagtctggagacctagaattctggggtggcagcctgtctcccatcagttcctaagaaatagatccaatttgctcacacatygtcccttgcccagggatgctgagagtgtttcacaatagaaagtgcatctccctatcctcagaaccttataattcctttaggtgctgagaccttggcttttataatagcttctgaaaaaaaaatgggaggcggaaagagagggagggaatgacttaaggaaagaagaggtaaattgccatttattgactatctctaatatgtagacatggtttgctaggcaattctatatatgccatttcattttgtctccatcactccccagtgaggtaaggattatcacgttacagatgaagaagctgaggctcaaagaggttgtcattgcccaattcacataacgactgtggcagaattagctagctaattccactgcattccatcctgcaagggcaaccctcatacatgtcttttaaaaatatgcaacacatgcagacagagaatgcaaaattcagttgtgaaaagaaggtagttttgtggaaagccctgccgagtgtctaaaggtcagaggtcgaatggttctgagtgactgttaagtccagtctaactgacctagagatggagaactaagtgcactggaggggaagcccatagacaaagagatgcagccagaatctactgatttttttcattcatttatggacacgctcatacattcgttcatttgattgtccatttgttcatttacttattcaataaacatcgactatgcacctccaagcagatactcttcaaacactaggaatacgaagtgggaaatgcctaggcttttaaaaagcttaccctggaaagaagccagaaactcagtggctgataacaaaaagcaaataattaataataataataataataactgatatgattcactcatagcaggtcccagaaatcaaggaaaaaagctaagggaaaaagggcttatcttagaagacatccaggaggggtgtcagatctgagcctctggatgagggggctctcttagatgctttctcacatgtctttggctctgcttggggcctgtcttcttgggccttcatcttttagatgctctacccactccaacatttgtctcaaagggcctctccacctttctgaactttggtcttcccatcggtcaaaaaagtaagctattttatacttacagcttcaggggatggtatactttgaaggagattatggcgttcaaagcctagaccttaaaaccagataaatgtgggtttaattgctgactgtcactacctatgtgtacgatttggggcaggtcatttaacttctctgtgccccagttttctcttgtgtaaaccagagtcaaaaatagtacctatctcatagttacggtgagaattaaatgagatgaaagctctgagcycagggcttagagcataatatttattaaatagagaattttgtgccgatgaggatgaggatactgatggtgatgatgatattgacgttggtggaggtggtgatgttagtgatggtgttttcatgctggtgatgatggtggtggtagtggtggtgctatgatgatgatgataaaaagaagatggtgcagatgatggtggtgttggtggtggtgttgatgatgatgatggtggtgrtgatgatggtggtgccaatggtgctgatgatgatgacagtgatgatgatggtaattgcaaccaggaagaaaagatagtctattcttcctaccaccaaggcaggaaatgaaagccttcttacaaaacctgatctgaaaaagctctggctgggctagatgtctcactggtatcaagaggaaaaaggctgacatctgaggggccccatctgagatctcccaacttctcctgtaaacagcctagccaatccttcagctcccactgcctgtcccctttcccagttctagcacacagaggggtcctgtagtgagacaggtggggcgtgcagccctgagtaatagtggaaaatccaaaagccttggaaagataaataggcttatgcagatagtataaaagtcctttttccaaactcacgtcaggtaaacctcaactgacagaaacttgtacaaccacaccaagacactcctacagatggattaaattagctctcaaataaacaggggaaggcatgggcatcgaatccctagtggattctaactctgctgttttccacttcttgaacctttaccaaatgccctccaacatctctggattttgactgggaacagactctcatactgagagaggaaaatctggttaagagaatgaaagcaggtgatcctcttcacccagccccatggctgggaggcagagggggaagaacgtagcttaattgaaagaaaggaatactgaaacaacccaaattccctcatttgtatttgtatcacattccttcatgtatttcttcactgtgctccacgcttcaccctggaaggatacagaagtgtctataactcaggatctgccctcaagaaacttaagaaattggtactaggtttaccattttcacagcatttatatgaatgcaccatctcaacaagtctatgatgttttcagtacctatcttgtggatgagagaaccaaatctcatagtggaaatgtacaaagcaattccaaatcagaattgcaaccacatctgtcccatatcatatcccatgacttttcccatataccactttatgcgtgtactggggatgggtagacaatttcaatagaagcagtaagatgcaagacagtagatttcacattgcaagactgattggaagatcatcaagttaagctctttctccaaggtctttgatttacttgaaggttgatagtggctacattcagcctatactaaactgatcctctaaactagacttgtttagaggacaagtctagtgcttgaccttagatgatcttctgatgctctagaagacaggaagacaagtaaagaaattattgtccactggtaaaatcatctctattttgagaagaatctgttcctttataaaataaatatttatttagcatcccctctgtcaggcattcctgaaggcatggcatatctaatgtgaacctgagattttatggagcagagaagaaaggcacccaatccagtcttggggtcacctgattccctctgtcacagcctcaccaagaggcctaattacaatttggctaccatataggtctgccctcagggagagaataggctgtttacatggattttccacattttggcccaggtgactcttcattttttaattaaaattaatcaactggcctctcagtcagtygaacaacctctgatcatgtggacttccatagttggytgttcacagttacctgtcactacacatctaagcatgtaccattttattttatttcattttattctttaaagaaataattgtaatctggcatgaaaactggggcatccatggagaatagaaaagggaamttccaggatttttttwtttttttttttgagacggagtctcgctctgtcgccaggctagagtgcagtggtatgatgtcagctcactgcaacatctgcctcccgggttcaagcgattctcctccctcagcctcccaagtagctgggactacaggcatatgccaccacacccagctaatttttgtatttttagtagagacggggtttcaccatgttggccaggatagtctcgatcttttgacctcatgatccacctgcctcggcctcccaaagtgctgagattacaggcgtgagccaccacgcctggccaagcttctagaatttttatggtaactgtattcctaatactatgttatctttctagtcttatttagctttcttatttcacccactttttaaaatatcatcatgttggattttatgttatgagctttattaaatcatttctgaaacaactggttattttcaaatcctggtttctccaccaaacagctatggagcatggggaatttactctcttatgacacaagattaatgcccacctcacatcatcatggcaagaaataaataagataatgcatacagtaattagcacaatgaatatactcaatatattttagttgtcattatcttcatcataattattatttttaaagaggaggctataaataagtgcctataagctctgcctaacggggctaggaaaagtgccaaagaagacataaattttgagcagacatttaaaagattctcaaagtgacaaaatggggaagggcattcagggaaggggaagagcaagaacgaattcactgtgggcaacctcagagaactgtgggcagaccagtatgacacggcagcaggtgacagcagaggggttctctgcctttccagggatttgaaccataggttggttcataatagcccatgtgctctcagactgtagtgtgcattggaatcatctgcaaggcttgctaaaatgcagagtctcagggcctggtctcagagagtccaattcattaaatccaaagcaggtctgaggaatctgccgttaattaaacacactcccacggcaatgctgatgaaagtggtcttcagctcatgctttgagaaatgctgctccacagttttctcccatccgcctgctgcagtcacacacatgtatgcacacatacacacacacacatgcaaacacacacatgmacacacacacacacacccctcctccccccaccttatcccaactccacgaatgggtcgaatattagtygagaattttctgaaaggcctttctgatcgtgtctctaccctccagttctgcttctcctcaacccttgttcctgccagggaaatacagaaccatgacacatgcggtgaacacaaatattattttaatcttgtggctcctgttattgcaagtacccgggcaagttctccatgtaaaagccagggtgaggtcaggaattggaaggtcccagaagaggtgaggtggttaaatgtaatgccaacayggaggtgggtccctcccaatcccaagcccatctgacctttctctccctcttcccacagagagttgtctgcactgctggtctcaagtggtatcctcaccctgctctgattcactgtgtcaaaggctgtgaggtgagtcacaaggaaggcactcctcagttccctggaaataatcctgctgttgttattgttattgttatattaatgttggctatcctttgccatacctactgagtgttgaaaatatccatttagcagacttcttggacagggattagcagccttattttacagatgatggaattgaggcacagagatataaagaaacatactaaaaagcatagggaatgggtaacagagttgggttccaagccaggcttttgtggctccagagcctgtggtctacaaaatatgggatctgtaagaaaggaagggcagggggctataatgatttaccatctagaatatgctaatgttggaaatttaccaacattgttacatttaacctttacagagtcaggtgaggtggttttatttttaatttccattttactgatgacctttacttgcagacctattccttctgccccacatcttagtcatttactcatgcctcaatcccagaaggaatatgaatgccttagacctaaccattgagctgaagtgaaagagcctttataacccttaaattctrtgacttcacagttgagccattccttacagcttggaattatagagatctgtctctgtgtgtcagtgacaagcttgggaggactcaaggagcatggttcttgggagatcagctgtgtcctgaagggagggctgtccacggaactcaaagacatttctgcacatcactctgccccttgtggctcttcccagctggcagtgaaaaagcggccccaaatcccttccaggtggatggccaaatctctgtggttcatccagagcccactgaggcaaacgcaggtgaaaaggatcagaccatgccctagaaaaagtcgtatctgatgaaactcttagaatgccagaaccagaaagactcttttacctaatctcaactaatcttttatttttaaaatgggtaaacagagacccaggcagtggctggatctaaaatttgatggaatgccaaaactgggaaggctcttaatttgatctagctctattttcttggtgtatagagtagaaaacgagggccagagaggggatggaatgtccaagtttgcacagcatgataaccacaaagacaaaacgtaagcccagctcttctaacgtccaggctggtgcttttctcctgctgcctgcctatgatccattccctgatctgtgtcacaagacaatccctaggttacacatttttttctctgcattgttgagggatttcctgagggcacttgacattgtacttgactttaggaaccccattctctcaggcttcaattaggaatggcaaaatcaaagccaaggccctgtggctgttgcttacttctgtctttttggatcaatccagcattttgggaaaagaaagcttgagttacctgggcactcattctgctgagttggcggtctgggcaaccagtgtgacagcggaattcaatccctccttggactcagcagtgagacccaagagaccctcacctgtcagactctgagccctgccagtgatgtttatcacctttgcccttgcaggtgcccctcatctcctgtcctctttagctttgttctaatagtgccttgtctggagctgaaaattatgcttagaagacatacaaactctgggactatcaaccttgaatatccagaggtatccaagataaagaaagggtttggggacccctgagcccctgttttctgcaccaygctgggtccaaagtgatcattcactcacttgttcaccaaagcttcactgagaacctcttatatgccagatactgttccagttctgggaatacattggtgttagtccagtgaaaatagtaactatgctctccttgagtcatctatgatatcttcttgcctgtcatccatccatccatccatccatccatccatccatccatccatccatcgttttactaaataaacatttatggaatctatatttgataaagttttgcacaaatacgagacattttgctagcaatctaggatacasaaatggatgatgcgcacagtatagtgaaggagatagacamttaaagagagaattttaaaatcctgaagagctatcacaaaatcaaatacaagaggctatggcagcagacagcatcctgaggctattaggggtggcattttggagaggtaacatttgagctagatcttgaaggatggtttgtttgtctgaatgcgttactagtagaaggagcaacatgagataaaccagagacaggagaaatctctaagtaccagagcttttctcatattgttccctgtctctagaaattctctcttctccacccccacctaattaactcctactcatctttatgatctcagctgaagcgtcatttcttcagggacttcactgagctccctgtctagatcaaatctttctactytttaatagcatcacaaacctcttctccatagctcttatcagagttgaaattggttaattagatgtgtgattatgtgattaaagtctgtctcttcaccagagtataaggtctggaggggtaggaactatatctatattaattcactattgcatccttttccttagcataatgtgtaacacatcgtaggaattaaatacataggatggaataaggataaatgaadggatggatggatggatggacggatggatggataggtggatgaaaggatatggttgcaggaaagaacatatagggtagagtaactagtgatgggactggagaattttttcagggccaaataaagaagtatcaccttcatttaatttttctcttttcccctagctacttctttatcaagccagttccttttattctaaggaagggacaattagtctccatcattattctgttcatttattacataaaaaagarcataacccacaggcagatctcctgaggcaggaaggaaaagaaagggtttattgtttgttgtttgtttataccccactgctctaatgtggatgtgatgtgttcattctggtggtcacacagcagagtcacacctgaacccacagccatatgcatgcacacccacacaactgagctcaggtcttccttgctctcagagctctgtctagctgtgatcttttagactctagtagtagagtgatgaaatgaaatctggcatcatgagttcagggtgaaaagtttctgtgagtaagaatttggaacagagaggcaaaagccaggaatgccacatgggatggagcttggttctttctggagcagtgaggatgggaaggggagaccactggatcacagatggcatgcttggatgcaaaggtcttaaacaaatgttgtctctttcccatgaatgagtcactgatctttagagaccccaaccagcactttaatcagagtggtttcactttcatctgctttctatattgaaatgtcacacaatatggcatttgatggtgaggagaggggtaggttcactgttttgagaaatcaatggactaatctggcctctttatttcattagtgggagtcctgaggcctagaggagataaggtcacttaaccaaaaccatgaagtaaccatcccattggctgaggttgggaggactagaacccaggttttctcaatccctgccaactgcccttgccactatgccggtacaattacattccacttcagaaacattattaagagccaaagttgtgtgcagccttaaatgaggtgattgggagtcaaagacaaactagacattgcccatgtccatgaagagctcacagtcttgcaccagctacagaaacataaacagaccacagaatacaatgtgctagcggttgggatgaggaaatacaagtgactggggaatccaagagactcctggactttcccctaataaggctctgggttcagataaataatggcttgactctattatcttttcttcatcttgggagtgtcctggggtggagaaacacacagaagaaaagaaataaatcagtatatgccagaacagccaagagagatgaagtaaaaaaccatagagccaacttagatttaaatcacttactctgactgtgccaatgtgattttgggcaagtccctgtctttgagtctccgcatcttcatctgtagagtgagaaaaccaatacctacctcacttattgtttggagagcaaaagaagaaaacaaacatgtaaaatgtgtgacatcaagtacatctgccctccttgtgagagggagcccactatcacacacagaccatggtgccaaattcctatgagttcttacattttatcttaatgcttcttgggcagtttacattcagcttcctaacatatttgcatatattttattacaaattacgtttttaattacatactgctgaaaaaagtgggagaaggaggcttacatttcctggtcatttmtttgagtaaaatgagccctctttcaggaagatgtaagccatctattttgtggttttgcatacccaagcacacaagagtatgtctctcagcataaccatactctagttggaaaaaactgggtaagagtctttatgaatggtagaaagaaagataagagtctttatgaatggtagaggtgataactcattcaagggggtgttggggatgtgaagcctggccagctaatcgtggaaggctgtgaaaagatgacagacacccgaaggactgcagacgtcagctcccactcactccaggatgctaacaaggcctcatttcctccttctgtctccctttccagcccttcatgggagacaattattgtgatgccatcaacaaccgagccttttgcaactatgacggtggggattgctgcacctccacagtgaagaccaaaaaggtaggccagtgtgcactcctcggcagctgcctcctgcccacttctccagcttgtggggccaggatcactccttcatggctggacaacccttgtcctaactctgccagcactgtccacacgctttatttctttttttaatttttattcttttggtcagtagttgaactaatatcataggctgggccctggttgatttttgcagatgtggttctcaaagcttagaattgggtacggaagcaggtaataaaactgcaataagtactttcggaaaggaaggacaaagtgcttggggggctaggcaaggggtcagagaaggcactsyagagcaagaggcatctgcactgaaacttgagggataagaggaaggggtgaggaggtggtcaaaagaacggtgtctggagcaggagactggcatgtaaaatcccagtgagaacacacatttttagggggtagggctgaagtctaggaaacagaaaatagtacatccctaatgaggtcatttacagtctttgagcattttattatctatcttatttgtcacacctgtagaattagagaaagatggtcatggtcatggtattttttctttatatcaggacacacccaggagtgattcaagtgtttatagtaaaccaaagaaaaacattcgatagatgcacattaacccctcacagaaaagtggccacctccatttttctccgactgccgctgagaccagagtgaggagccccagccaagggttgggagggaggtggtaaccctgctagcctgggctgagaagcgttcttgtgatgaatgagttaatggaaaactatttctatttttatattcatctgcagtcagagctgaaagatcatttcatctgtgtcattttaaagaagggggaactgagtttctgagacaggaaaagcaaagaatcatagtcaatcatgcctaaagagccctctatgactatcttggcccaaacgyttcattttattaataggggcactgaggcccataaaagaggaatgatttgtcccaggtgacaaagtgaatgatagaaagagtgaggttcctggattccaatcccagtccctttattttgcaacatccttaggagagttggtttcttcaagaaagaatctctgacccaaaatacaggaacaaatgggacaagacccaaggaacacattctaatcagatggctgttagttactgaatcttttggttgaggaataaaatttctgggattgtccaggatcagtcagtcccaggtgggcaacagttttcagcatgcctacccttctttggtttcggtttggttttgatttttgattgataggacactgaagacgtacaatttttgcttaagtagagaaaaataaaattcattttctgttaaggaattttatcatttttttctaattatgaaataatgcatattggaaaattcagaaagaagaaaacaaaagaattcacttattatcttaaaaaccaaagaaaaccactgctttttattttggtgtattttattctgtgaattttgttaagtaagtgtgagggtatttttgtcgtctgtgtatatatcactgcctttctagcttgcaatcttgttttgcttagttttgtttacttagcacaggaaatcttagacacaagaattacttgcgctgagcacagtggctcacggttgtaactccagcactttgggaggccaagatgggtgaatcacttgggaccaggagttggagaccagccagagcaacacaggcagacccttgtctctacacgtaattaataataataataataataataataataataataataataaagtagccaggtatggaggcacaggtctgtagtcccagctacttgggaagctgaagcagaaggaccacttgagctcagagaggtcaaggctgcaatgagccatgatcataccactgtactccagcctaggcgatagggtgagaccctgtctcaaaatttaaaaaagttctgatagtagtataaacttctcagctgtattttttgctgcattgttgtttattatatggctgtgatgtatgctaatttatgtaaccatttacttcaacttttatttttaacttttggattatttcttttttcttataattttaactaaaatgatgctcatgagcgtctttgcacataaaatacttttatagctctaattatttctttatagttgattcttacaattggaatgccaagggagggatgtaagcatatttaaggctcctgatacctgtttccaaatgaatatagtgaacaatattatctattttcttccattggagtcagccacctttgaacgtgaatggacgatgaagtttgtatttgaaatagaagtttttacagaattatggctccatctgacaccaacggttggagaaagagcagctctgtttaaaataatgttcctatctattgtaacttaggtactaaaatataaaatatgaagctgattttttgacagagaactttccaaaatggattcctctctctacagagtgcattgtgggaatatgaagtcatgagaccagcctcgccaagatggtgaaaccccgtctctactaaaaatacaaaaattagccgggtgtggtggtgggcacctgtaatcccagctgcttgggaggctgaggcaggagaatcacttgaacctgggaggcagaggttgcggtgagccgatatcgtgccactgtactccagcctgggtgacaaaacgagactccatctcaaaataaataaataaataaataaataaataaataaataaataataatttggaatcygcacctgaacctcaatctcatgacttcatagtcccacaatgcactctgtagagagagaatccatttggaaagttctctgacctcatgatccacccacctcagcctcccaaagtgctgggattacaggcatgagccaccgcacctgaccagattccaaattattatagtaactttaccrtatacatatatttgaacaccaagccaccattttggctctctgttcccatactcagttccagwgcagcaatttcagactcccaggccccaagataagcacagactcttcactaaggaaccccagaaccagttctttgctagctctgaatgcatttcatactgttgtttcctccttgtctacccacattataaatgtagttaggctttttgtgttaagaaatcctcttcttccactttaaattcttgtttcttcttgttggctgagggtgcagaatgcagatggccaagctgccttcatccaatgcggtgaatctccattgaggatctctgtgtgctcagcaccagaccaggctgtggacagtatttctgcccttgtgaaacgtgtagtctattagaggagcctgttattaagcagggagccacacaactattgcatttaattacttttgtggaagaggcaatgatgagaaagtgtgagattttatggagaacagcatgaaggtccgagaaagcttctctgaggaagggacatttacatggagatctgaagagggaacagagtcttcctggtggaggtgaataatggttgggggtagaaggggaaaggtctcttaaaactgtacatgaagtatggattagagagactaagggcctcctttatggcagataggactttgccatcattatttcagttgtggacaggtgtttggggcttttcagatgcaagattcctagaagtcttacttctggaaaagtgtctcagattaaagtcacacttcctacaatttagatttcccagtttgacttttaagggaactccaacttcttgaaacttttctcctctttcttggacacccccaactactccctgcagtagactggcttaaaggtggtgctagatggagaaaataaataagaacacaagacttccctaagtgaactattgcatatttcagacactctgcgagacacttggcctctgttatcctctttaatcctcttgtcaacacagagaggtcactattcttattcccatcacacagatgaaccagtctgggcttrgagtacatatgggacttgcccaagttcacttggcaaatgagtggggaagcccaagtttgaacccagttctatctgactcaaaagttctgctttttctcctgcatggtgctgagtttcagaagaagaaagcatgcagggtgcctgtgtccttggcacaccttggcatgaccctccctgttctggttggaaacatttcaccatgagcccagactgccagggaactttggcaaagaggagagcagcttttcccagtagcagcaaagatggggtcgggggaagataagtctcccagccttcccatcatccctgacatccctggcagcccagagaggagtttcccgtgggcatccacagaacagaagaaagttctggtttttgtttccatcttccaccgcaggaagcctctcagagaaggagagaggttactttcctttcatgcctctgcccttacctgctggacctgtttaggtcccacttgtcccctcagccccagtcccatatcaagasacaatcccttcccttacacacccaggctagcgctcagagaaactcacccctgggtgagtttcaagcaccttcctaaatcacaggaattcagttaactgagcacttaatatgtgcttcgctgtggcctggatctctgtgcatgtcatctcacttaaactccagaataattcagccaagtagagcactgaggttgagggaaatggaataatttgtacaaggtgatagagctatgtttgggatttaggatttcctaactgaacaaatggtaatagctaagagttattgctttgctttacatgtcgtttcatttcatcagcacaataaccctgttgtagatgttgttcttttttctttttcttttgagatgaagcctcactctgtcacctactctggagtggctcacttcagcctcaacctcctaataagctcaaatgatctttccacctcagccttccaaatagctgggactacagacacacaccatcacaccatgctaattttcatattttttgtagagaaagcagtctccctgtattgcccagactggtcttgaactcctgggctccagtgatcctccagcctcagcttcccaaagtgctgggatcacagatgtgagccgccatggacggccctaggcgttatctttttaatcctcattttatagatgatgaaactggggcttagaagggttaaattcacacagttagcaagtggtaaagctaagatgcaaaccaagagaattcaagctgcacagcacctgcctctaaccccttggaacatccttttgcagcaggcttgtgtcttgcccaagcgtcttgtcctgccccttgtgggtgatattctkgcttcatagacctccaggaatggagttcttggtatgaactccaggcccagagttaagcactcagcatcttctcccagacttccttcttgccagttttccacctaaacttcttcccggttcccagggctagggcctccgtgatgccttggcccagcatgatgactgtctgctcccttcattctccctcccttatttgtctgtacagacaccagctgttccccacatccgccttatggggtgacctgggcccggctggcagacaagagcaagacggtgcaggaaactctgtctgacaggggtgtccaatttcccacccagacacctgcctgcagtgtgaggcagacaggaaggggcaggactcagcctctcaggatgtcagtttattattttcctgttggagccttgaggagcctcaaatacaaagcagatttccagaatggttgctccagtggtttcccttcatgacaaaaaaaattcaatttataattggaatcattctaagtaagcaygtgttagggtgtgagggagaaaagggaaacaaccttaacatattcaacataccaaagctttctaaggtgtggtggcctggaacactagttgtggtcatgtttcagatggctgctaagagagtgattcttatagatgtctggggagttggggtatagtcctggttctgtgacttattaactctgtgaccttgggtaggccagactcactttgggtttttatgttttgatatttgaattagattcctgtctaataactcaacataacaaggctttctaaaaatgtgcctaaggactcttcacatggcttcctggatgagttggtcattgagcaggaagttgaaggctagttaagactgagacctacagagaataagaagaggttaatcccagaaacacatctcagcacaggatggtgcacccaattcatgcaactatgtgtagggctggctgcaatatttgctaaatgacagatttactaaatcttaaaccctacctaaatgagaacatggtttcttaagaaaagacattatacccaacatgtagcacattggtcattggtctaagaaggctagtgattctataagatatggaaaaataatcaacatcattacatggagagcaaccttcttagcagagtgggtgataacctayattgacaaagggctggatgttgggtagctgacttggggatgtacatcagtgtctcttcttgacctagcagccagaataatcctttttttttttttttttttggaaacagagtctcactcttgtcacccaggctggagtgcagtggcataatcttggctcactgcaacctccgcctcccaggttcaagcaattctcctgcctcagcctccagagtagctgggattacaggcacacaccaccacacctggctaatttttgtatttttagtagagacggggtttcaccatattgctcaggctggtcttgaactcctgacctcgcagaatagtccttttaaatccagtcagatcatatcacacctcaatgcaaagacatacagttccttcccattttacttggaatgaaaaaccaaagttttcccaatgcctacaaagctcttgggaaaatgtgggtgctttgcccacccacattgcttctctgactttgccccctttccactgtctatgccttttcttattcacctctggcattctggaccccttgctatccttagttcagctcaggcatccttctactttacagcctttgtcactgtgtcactggcaatttctttggctgagaaccctcttctattcatcctcatgactcactccttcacctctttcaagtctttgcccaagtgccatgttctcaatgactccaaccctgaccacccaacccacatcacccctggcactcccacactcatttgctttgccttctgtttttttttttctttctttcttccctaatacttatcaccctggcacacactataaaatatatttattatttatgatcagatgacccctactcctcttgatgctagaatgcagaattaatgaggataagaatgtgcttcttgtttgtttattgatatattcaaatttccagtgtacctcattgtttcctgtccaatagtaggtactcaacacccacaaataaatactttttgcatgagtgaatttagggtattacctgctgtgtgacagatactgtactaggccatgagcaagaacttggtcccagctgaatgaattcatgtcttatggatgagtagccagacatttagagtatagcaagtactcatggagacacagcaagtcaggaggtcagcgaagtttcccagagaaggcaacaccaaaggcaataaatgaaaggtccagaaggtatttcccagatgaaaggagtaaggaaggaccagagataggggtgggagggaaaagggtatctttggcgagaggaacagtctgtgcaaaggcccagacaccagggaaagtgttaaggaaattataattccctgagtatgcccagagcatggtgcaaggggaaaagggataaaagataagcctagatggataagcaaggcttttatcacccaagccagggagattgaactttatccagaggccagtggggggtattcaggaggatttgaagcactgagccagtgtagggaatcccagaaggccttttggaagagagagtagatatgcttaacttggaggattagtaagagacaacaagcagatggctaagcacactagactaactcttccatgttcaaaaattactggcttctggaatgttattaaaccctctgcctccccctgccccccgctttggaatgtagccctgactttttccttatggatgaagtaggcactcattttagcttggtcctatgatggaatccagcccttctatcccaaaaacttatcagcatcattatcaatgttattaccaccaccatcatcatcattacctcactgtcaaaaccatcaccaccatcaccactagcatcatcatttattgagcccatattttatgccatgcattattctaatgctttacttgcatttcatactttacccaacatacttctgtgtggtaggactgttagtacctcctttttacagatagagaaactgaagcccagaaaagggaagtaacttgccggatagcatacacgaaagtcagcaacagggcaaagactcaaacgtgtctttttctcctctaggccagtgctttcctctaatttacccatattttttccactttatcctccatttatccacatgaccactttatcttcatttaaacaagcttcgtatacattaactgttccacgttttatgccaggtactgtatccatcctacctttaagaaacttacaggggaatcctygtccttggcatcatgcctttatctacttggtactcatgaaatctttccatcagcactgtcaagaccctaagactcaaccaggtgaagtgacctgccagtgatgtggccccccacagccagcaggagacacagtcaaagctctctgaccatcagcacaacatgactgttgtccctctccaaccggcacccccaccatgctctgctagttacctccctgtggagtctgagtcagaatccagcccctgcatgtctctcagctctggacaggatctgcagccagggccttgtggtatagttgcctgagctgcattcctgagccactcacactcacagatggaggtgttagcctcagcagctcacccagagggagaacccatgtgccggagcaccatctctagccccgagtaaaaacaggagagaatcctggcccttaatcatggacctggcttgctaacacaatcccagagtgggtggccaagccatttatgggacagcctagccacatggtgctgagaatccccaaatgtaaactggccaccatggtgttcatgctgtgggtggtaggttttcttgggaggccgcctgggggagaaggtggggagctgcttggggagtcagggaatctggcagttgggctcagagctctgattttatcaagatgtgattcttctctccatgcctcagtttcttcgtctgtgaagagaggaccctgactcctgctctgccgtcctcctggggcatggtgctgaggagtgccaggccacctgacagcccactgattcatctctttgcatcttagtttcttttaagatgtaaaatggggatagtaagaatagttacctcttagcattgctgggcagagtgagtaagataatgatgcacattgagtttagctcagtgccaggcacataataaggataaaggttattggtgattaaaaagacaaagcagcagtcagccttttcaggttgtgaagaaaataccttttttttcccccttctttttactctcacttgctgaaaagctctcaagtgtttgaagtggggtttggaatcctgcatcascaactcactgactggtactgaggcctgagacaggttagttttgctttaaacattctgaagcctctattttctcatctgcaagatggggagctaataatgatagtctcccaaggtggtgcagagtcagagagctagcatatagaaatcatctggcatgtggaaggccctttggaatcactagtgtgtgtacaatggtattcaccgcttgagcctgcatgaacaggtgtccccaagtcctttccaggttagacctagcaatacctgaaaatctccacccttttcttctcagctttatatctgtgataagtgaggaagcttgtaacagaggaggctctgaacaggcagttcacaaagaggcaagaggagggaagaaaacaccatgtgtctcctctacattgggcactctgagagctggactggacctgacatgacttcactgactcctcactagagcccttcgaggtcttgataaagacccttgtcttacagatggggaggmtgaagtccacaagatgccagggacttgctgaaagtcatacagtttctgtataaagtctacaacatattacttacaagcatgtagtggagacaaggaggctctggataggcctcctgagaccaaccctcctaggctttgtcatattctgattgagtttcctccagtgtttatttcggaagtgctgaaactgcccagactggcctggggaaggaagaaaaaggtgacaccaccccagcatagccagagtgccaagaccggcctgagaagctaactggtggcaaggccttaccagccaacaattttggagaagctgattgaactggggaggacaggaaggggagcattcaagacagggtctgtgaagaaattctatgtttcaagttcctttctggccaggtctttgccttctacctttctcagactgagaaggattttcagccagatgagaagttrgaagctatgaaaatcaactcttattataggcagggaaacaagctcagagaagggaagtaacttgtccaaagtcacccagcaactgactgtaaaagtggaggctccctgacttgtattctgcctgcatattcatgcattcatttgttcattcattcatgggtcaytgaatgcataaagactgagttcaataacagtcatggtccctgcccagagtgagctgacatcgaagtaaagaagtaattcagtatcagaagggtgcaaaaataagatgctgtgatatggtatgaaggtgatggtgctattaggttggtgcaaaagtaattgccgtttttaccattactttcaatggcaaaaaccacaattatttttgcaccaacctaatatctttggtcagactactgagggaggtagtgatacttgcgaaaagacctggacaatgaaaaagagctggccagggaagagcagtcagagtggagggccattagtggctaaggacacaaaagtaggaaaacagagtatmtggggaaccaataaataaagaagccactgagagtgaggaggagaaggaaaccatgtaagatctgagacttatgtagaaatcagatcatgcaaggccttgaacttgtggtaaggactttggattttattctaagacatataattttttgaatgtttgccttgagtgaggtgcagcagaaagcacaaaagataaagcagacagacatgaaaccatccctcatgggtgtttgagctcaatgggaaagtgttacagacagaatattagagaagacattagaggtaactggatcgtgctaatgatagaatgagagcaagggtaggagacggggatggataaagcatgggggagttaaggacaaggagattgttcaagtgtggaaggtgggcggtgggggacaataggcaggaaagatcgtgaaatacgagtgagggagaaatctgattcagcatatatgtatttggcactgagcatctcaagggtgttaggccatgtgctgaggcttttgcatgtttcttcttgcttgatcctcagaaaaaatgcaacatgaaatatggtattttaaaaatcctcctttcatagatgtagaacctaagatcatgacagtggagggattttcccaaaatcattcaacgagtatgaagcaaacaaggatcccaacccaaaccttttggctttcatgatagtactttccacactctaccccagtggttggattttgacttggctttgccctcagtttccctgtttggactggggggttttctctctatgccacttccagttctaatattctgtgcttctcttcaaggtaaaatgaataggggcaaatattctagattctagatggaatatcctagatgtattccacaaagtcacagaggatggaaagtaaatgtcctaaacagagaacagcaagtagctgtgagcaagaagagaggtgcwgcttggaaaaggggacggtggaaatgcttaccacagcatcaagcacttatgaatttaaattgaaaagagaaacaaagacttgtggtagccataagtacaaagagtcagagagagatggatcaatgaatacaaatttattcattctgtggcttagggcctgtgaaaacaggaataaacaagattgacctggtccctgccttatgggccacagaattggtgggaggatagaccaaaaaaataaaggagagggagcgggagagagaaagagmcagaataattgagcacttagcatatgtcaagcactgtgtgaggtgttttcatgagttatttcatgtattccttatcacaacctcaggaggtctacacttttatttttcccattaaatgaatgagttcattgagactcagagaaattgtcacatgttcaaggtcacatctcaagtagatgagagagctggggcatatacttaaatctttctgatgttccattctacattttaaattattgcaaactttcaggatggagagaggttgggagggagggaaagaggtcaaagaggcagagaaaaaagaagaggtagacattgagaatgagtccacaagtacatgagagagaaggatagaaacaaagattctctctgagactacgtgaccacttggagaccctgcccaggcaggaggcaaatgaggtcattaaatccatctgcgcagatgggaggctctctggggaaagttatatgcaaatgtcatgatgcaatgaggtgaaatctacttgcgttagttcaggtggggactcaagcaggaactgcactgtgctctttggaaagatagattatctcctggatggggaagacactcactctgttgggctcttcctatcagtttgcagaaaggaaagctggccaaggtcacagagcacatgaaggaacgaactggcaactgtattgaactcagttctctcacttgttcgtatgctaaaatctgcttcccaggtccttcaaatttggtgcaaaaccaccatgcgatctattccctactcaggattccaagcctcccagaaggtggtctagcttccctgagacatgctttttgttttcatcattgcctactaaagtcaaagtgaccagtatgtgcagagacttatgttttctcaaaagacacttmcacatcctttctttcacttgatcacttatacatcagatattccattacacagttctattaatcaactttgctayagtgcacgacaattttccacccatgattttactcagctcctatagtttaaaatacaaagtgggtcttattatatcagctctacatagggacctgaggctctgagataagtaagtagcttgttttactttaaataccagacttgacacttattattacttttggcaaattcttattcctttctgagcttcagtttccccatcaataaaagggtgattgttgcagcatctgtcttatagagttgtcaaaagtgttttcttgtttggaaatcactgagtacattgccttaccccatagcaaatgcctgacccatagcaagtgcctctgcaaatgaaaactgctgtgattatgatcatggtgtgctcgataaaagttatcaccaggatagcaagaagcagagccataacttgaacttgaaccttctgctcctcaaatccagtgattgtatccctgcgctgcactgcctttctgatcattactgcttcagaccaaatcacctgattcacttcttctttctgcaggtcaccccattccctatgtcctgtgayctacaaggtgactgtgcttgtcgggacccccasgcccaagaacacagccggaaagacctccggggatacagccatggctaaggaaggacaagaakttgtcaaagaattcccaacgccaggacccacatccctttggtattgatttcacagtcagctgctcaacggaatggcctctccacaccagggatccttagcacccaaccggtctgcctttaattttacscaggaaggactcacattggggcgaatgaaccaagtttcgccatgctggatgatgaaatggattcccatcccaaagtctgagatggattgcatatacagtgtgcagtcccagagcctcctaaaattctagccatttgtcacacaaccacagcaagaaacgtgttctatatctagagtgtgcccatctgtgtttagtacacatgcatgcatacacacccatacaaacatctgtgtgagggcagttctggagatgagcagagagagaccggaataaactcaatcttttctttcccaagctcctagccaacactatccttgggagaaagaaatttgcagaaactgctaagaccaagtgtggagatgtcaagctagttcacactctgaggctcagaatatgtaggacatgcacaattgtgcagtcctttgggattggaagtgaaacagtctgtgatcccctaccttctagggaactaggacctaggaagaggtaaagattatcaggtatgcaaagcgccccaattcttctgctgccatgggggattttaccccaactccagggttcgaggccaatctgagaatggcttaggattgcaatgtcaaggtattatatcagccccttgcttgaggcttgaggtcataatatccctctaggacttacctgttcccccagatcttgccttgggaccacatttgctgctacttttcctgctgctctatcctatacattgaataatccaagatggtagaactaggttaggaaaaattccacacaaccaaacagtctgccttaaaagtgacccacatttttccatagctcctcactttttagcccttctgcaagagaaaaaccctcatgggtccacatggtgagaagttaagtttcctgtaagtgggcctctcaccctggaaaggagttgagggacatcagaygctggaaccctcactgaaagtccagaatgtctaagccagtgttagattttgtaaacaagtggaacagtgttaaatttctatgatgttggagccatccagagactactggaattgtcgagacttttggattattatccttatccttatcctaatcttcctagcccttcaggctagagtaggcttcgatcctgagaaccttgctgttgctctgaggagatataattctgggagaaagaatcttttataagaacagtacagattgttctcaagagggccatcagaaggaagccaaagagttcacagcctcagcaccaacaactcaacatggtcatcatgttttctatatggtttttccagctagcagtactcccttccatacctgtgactgggcagtgcttttctctctcccatgtctagcctccaaaagttaagtgaaaattagtcaactgcacgtggaagmccccaccactttggggatctctttatttcttttcagccagggacctgtccactccctttgaattaatatgggaagaaattaatacaggatgaactggagagaagggttgagtgtggcatactttctgaaacctggagctgggaattgcggagaagggaaggtctagactagttacatcacatagggattactgtaaatcaagtcatctcaagtctagtgaagacagccaacagraacaaaacctagcatagggatagaaaataccatgcacgtgtgcagccccacctaattcctgcatccaaggcaggtgttgttaatctakcatagcacttaaaaaaaaaaaaaaaaaagagaccaaaaataacyttaggaaccaccatattatatcactcccaatagcactgacctggtgatcaaaaacacttgagaagacatctattggccatctctggccaattacactaagaaacatatcaaggtgcttttggcacaggtgcccacaaatacggatgcagtgctgagatagtttatgagacttgtaccatttcacaaactctgaaattgggttccatattggcaaggctgccacagttgttaagaataatcctctatgtttcttcctcacaaaaccatatctcatttatatccagaccattacttcactataattacaaggacaaattattagcaagaaataagaatagtattagaagaattgatcctattttgaacccctctccagtatcttcacactcttgtcaactctccaggcctctctcttgccctgagttatcagcctgtgtggtgttaactaccttagaaggtacragctaagaaatgtaacagtatcaaccctcccagttgcttaattatacccataggtaatacaaaaagctctgaagacccaaagatgacattactaatgatgtgatttcaggagccacagaagaaccttaccagcttccctcaaatcagtccttatcctctttctatcttcactcccatcatcatctattttcacactatccagctaagcaaagattcctggaggctgacttgtatcttcagactcacagagtgaattcagctcttctgaatcaagacccacccagtctctttcattcagacctgttgctaacaaatttatatttgccaaggatattaggcaaaagaggctacttgattggtggccaacctcgtgcccacatggaaggtatctttaatagggtcttttcaaaccttagtggaggagggtcagctcaatttgggcaatgcatttgttcccagtttcattttcttcctgggaattaactcgtcatttcattccttcagtcatcttctgtgtaggtgaccggagcactgagaggcagctctgatgcactattgtgtgtcagcagctcaaaggccctaaaacactgaaggttctgcatctgaagtattagattgttagcagcaaaatatgaaagatgaggtggacagtcctctaagccctatttagggaagcttttccaagccacaatcttaactacctacccaaaggatttgcattacccccagattctgtgccaacaaccttttaaggaaatacagtccttgggaaatgagttttgatggtgaattggggtgttaaggaagggaaagattgtcatagatggtagggctttgaaaatgcagggtatcagctgccactcctggcttcaacacattgagtcactgcctagacggttctcttggtcttattcccatcctggccaatgcttaaatactatttgttgaaaataattctttgagacagatttcagctacctcccttccaggttcgatttaacttggttgtaattgtcaatttgttgttataggtcttacctgtgtgaaagaaagaaaaagaaagaaagaaagaaagagaaaggaaattataaggtcaagttaacagttttgaggttttgtgtttttttctggaactacttcaagtgagaaaataaaaaaaaatggtgacaaagctgtacagatagagataatagaagacaaagagattaaaaggaaataaaaatgcatgattaaaaactaaraawaaaaaacctatttttatgtttcctaaaggaaattgtttattctacagmctcagtaggtagacacaaacataaagatttccctagaagacatagagtgggatttgataacactgtctgttattttctgtacattgtggtaggtccaggaaatatgacattttcccccttgatgtgttattgttgttgttgggtggggtgggcattttgtttatttgtttggtggcaatcagtggtagtagggagtgggagggcttatattggtttttccagctattaaggggacatattgtgtcgttgtgcttttcacgttataaaatgtttatatttaccagtacagcactgggctttataaagactgcactcagaaccacactgcacagtccagttttttaaaaagctgctacatgacagacaggtaatcccactgagtgagttttgagaaacaaatcaaacgaagtaaacaagaaacataaaaaccaaatagcaaatgaataaaagcctgttcttgtaacttattcaacttttgccaaattcctaccaatcacttgctttttaaaagaaatgtataatagccaaaagagaaattatgtccctgttgtacagaagttagaatttttgactccaggcagcagtttgctcagtgatcttgaacaagttatccaattgcctctacatttgcatcagtttctctagctgcaaaatggggataatactatatacctacctcacagtgggagggcaggagattttgaggccctgaggttttaggtgggctgtgagggccaacgcttgacacaaagtccatgggttattattcaagaatgcacaggcccatcggccttttagaaagacaagacagggagtgcttgtttgatatttcaaggaataaagccggagctcctgaattgtagtccaccttaaaagagagacctgtattggagaatattttatttttttggcaaatttgatcttaccctttaccagttctataatttggttaaaagctgattaygtcctacaatgtcaaagtcagctaactgtcgtctacttaagacttctggtcatttccaacttatagaggaagggagtctctaaaatctcttcttcagaaggcacctcacttctcagacttaaaattccacatcaagtgttccattaaaagaagataaggcattctgagtgcaaacaaatgggggcttcttaaactacacaccagcagtcagtgaggaaaactttgaacaattattgagttgctttcttgggtctctataatcaataacctgtctgcagatatctatctatataaagatattatatataaatataaatttacatatatatgcacatgtatatatagttgtacatatatgtgtgtatatatatacttaaatgtaatatttacaaaataaaactgtgatctcgtctagagaaaatgtattcatattacaaactgctcttccatatttatgtaccatattatacctttttwttrttgttataattattatgggtatttctaattaatatgatgttgaaacctgtttggcaccttctggaagctaccaaaaaaatgacactccattgaagtgcttaaaagctgttctcataagaattctwctggcctattgtaaaaaagaaaaaaaaaaagaaaaagaagaaagacacaaagaaaataatctaaacaccaaaaactaaacacaattccaatcctttttctgtacctcacgcgcataaatttgctgctcctatttttttttctgtttatgtgtttttatggatctaagttaaatcttttggcaatatataaaaatgtaaatagtaaactttatttattaagaatgtcatcttttttaatttatatttacacaattgttcatctaatttattttttctatacagttttaaatactcagacatattttgctgttcatgatatttttatcctgttctcatggatttgttttcccatactgttttctctgatctcaattacaggttggatctcacaaataataatgtcagagacagaaatattttgccactgttgattactatactttaaagttctatattatgaaaatatataatagcttgtacgcttcagtgtgttgttgtgtggtttttgtgtgttgcggaatgataaagggctgtcatatatacacgctaacatggagagagccctggggcctggaattagacaatcaatgatagaacaagattttatccaatatatatcgattcctctacaaaattaattcctgaaagtatctaattttgcatatgcaaaaactgaaaaactttcttacatgttataagaaagttctggggagctaaagcatatgtcactcttggttatatattgccttttgcacacagcctttaataatatacttccagatgtaaacactggtatggtccaaagacacaaaccagtgcagtggttcccaagtgctaagctgtggatcagagctagttcataactaagttttcatttgtctaaggcaaaatgtggggtcaattgttcattcttgtggagttctatcttttaagatgaactctttcttactcttccggtattaaaatgtcatattttatatacatatatacacacaatatatgcatatgcaggctcatatatacatatatatatatatatatgtatctccacacacacacacacacacacacacacacatatatataattttacatatgtgaaaatgagcctgcagctggaactgaaatgttgctgctttcaatctgtctagtgtatctcactgttcatcttatcactaggtagtagctatgagatttttagaaaattatttaatggctttaagatttagttttcccatatgtgatatggaaataataaaagtatttcataaggtttttgctagaattaaatgagataaatatgcaaagtgtttagaacagtgctgaacatattatattatctcattatgagtagtatgagaccagaattacttatgacaagtaataatacactaatttttctgatatctacttattttataagataatagaaacaaaatgcatgaatcattcaagagcttgcacaggcattttatgtagtaaatttattagcactgtccactgagctgctagctggcagtaccaccataaggcaggtcaaaatatgtgtttatctgctgataactacattttgaatttttcacaaaaaggctgtgtgggaacatcaatgtgaattatgtgtaagggcagggatagggaagtcaagaactactcatagtggggtggcttttttttggactctaaaaatataactcatggagaaacattagggagactactaaaaaagaaaaaaaaagtcattgctaaattcttccagataactggttattttcaaagtaaaataattgacaaaagaaaaatattttacacagttctattcaatgtgaagattgaaacaacatttagacaataggctcctgaaaagaggcaaatatttctcaaacagaaagattaaaagatgagagttttaatgtggctttttatattccttggtttcgtctgaagagacaaaaagtcatggggcaaagagcttcctacttcaagatgaaagatctttatcccagtatcttcttccatctttctccagccctaaacacacacacacatggacacacacgcacgcacatacacgtacacagacacacacacagagtaatggagagctcactggactttattaatctgtcaaatgggaaattatttctttctcacttcaaagtaggcagaaatattcagtattttgattcatttatatttataatgcaagttttggagtttgtctatccaaaaaaaaataatgtttcagtttaaaaaatttggagggggcactctattatgctgcactggcattagtaaatctattcagttcttaacctttaacaccagaaataaaaagtttggacaaaagcacagactctctaaccttcaatccataagaacccttgcttctttgagtaaatgctttaaattctaaaggaatgatgtttaaggtgagaaacagcggtgctgtacagaagcatgagttagcaatgggggaaaccaagttcaagtactgtccaccctgtgacttgggcaaggcactgaccttttcagagacagaaggaattggcaatgagaaaaagcaggtggtgtgtttaagcaaatggaaccagcaggtgcgtccttctaagtaagaaaaagtgtgacactttcaaagaactgaaaaaaaagccaatgcgtttagacagtagaaagggtatcagtggcccaaccagaggatggagaagtcactaagagccatacaaaggatttggggctctatcttaacagcaatgcagagctgctgaacaatatttagagatttacatggtcagatttgtggttgagaaaggtccctcgggtggcagtgtgaaggagttgactgattaattttagatgtgttttttttccttcttttaattaatagactgggtatttaattaaaaacctatttcttaaataagtttttagttcatagaaaaattgagcagggagtaaaattcacattagatttcagttttaaacaataaaatattggaacaggaaaatctagctattttctaggaccagctatcaggaaaatatagaaacctaagaccatgtgatcaggtttgtaggcttgcgaattcaaacaatgtccttgatgacccctcagtgatgttgtcataaggtctcaaaatgagataggaaggctttgggaaaggggtcagaatggaattaggtgagatctgggatcatagcctcttacatgctgtgttaccatgcagtgctggtaatgttctgtttcttgatttgggtgctgtttacacaattctgttcagcttatgaaaattcatcaagcacttaaaagttcacatgcttttctgtatgtatattatatctcgatatgaagaagttttaagagagtcatccgcaaaatttctccgtagaaagaagacattttttcagagcaattgggggaaggagaataagacaccatttaagttcagccacaaaagttgcccccctataacaccttttgtactataaaactggtatacaggggaaatgtcaaaggggaaatgttagcaaagattccttaaaatacaacagttttataatacaaaaggtagagcagggaagcaatgtgtgttggcattgtggaagtatgagtaggtaggagtcctagtttccagttctgctattctgctttatagccctgtgatcattgacaagtcacttaacctttaagcctcatgactcctcatttgagcaatagggataatgattaccaagatgaagatgagatgagctgtctgagcctgctgctaactgaacaccatgacggaacactaagagatgctatggagaagccagtgaagaagcagccaaaacaatggaatttatcccctgaggaaccccatcctaccccaaacagagctagactagtttttaatttgctttacccaaagatattccatgtactgacaatgaacccctgccaccatatatcttttttttttttttttttttgagacggagactcgctctgttgcccagactgtgccgtggcacaatcttggctcactacaacctctgcctcccaggttcaagcaattatcctgcctcagcctcctgagtagctgggattacaggtacctcccaccatggctggctaatttttgtatttttaatagagacaaggttttgccatgttggccaggctggtctcaaactcctgaccttcagcagttcacttgcctcggcccctcaaagtgctgggattacaggcgtgagccaccgtgcccagcccctatatccaattttgatatctactttctcctacgctgggttttatatccttgaggggctgcctcagatgtaattgaatcagtcaaacattctcagaaatttgggccacagaatccattcttcaagtgcaaaatttatttgaaatgccaagtcaaaagagcttctctaatcaaaggggatggggtagcccaattcctatagctccattctattttcttcagagctttggggttccaaagagcatgatgtaaaagcaattggtctaatctactctgttttacagacggggaaattaacagaggtttcattcagaatttgaacttgccacttgcccagagcccctgagtagaaaacacagtgacatcactaactaacttgcccctgctgctacctggtacctgggctctccccacaggggtcttgatgaaatgcagagatctgtggagtcttagaaatctgggcttcatgcctagggacaaaatgagggggatttgaaggcagtgaaggaccacagtttttgagatgctctgttttctttctgcttgacatgtagcccagccacagactaccctgggagtgggaagtttgttatctccatatttttctgaggctggaacatgtatattccagcctggactacatgcttagctgaatgtttttatttccctctttaatctttggcactccaaacagaatttttcccagaggctgcggagatggtgaccaagtttcttagacaacgtctgggtgtcagcttgttaaaatcatattagaaatagttctttccatatgtataccactttataccacagaaaaacacatttgttaacttatgaaagtattcatttactcaaatatttttgaacaattgtttattgagcattattatgcacaattcattggactaaacactgataagagtggtggccaagatagacatccacagccattttccttacagagtatccaaatattccaaatacaaagacaagcaactagctcattggagtgcaatgtgtgaggtgttgcaaatggggaaacccattgcagaataaaatggccaatattgcacgcagagaaaacagcatgtgcaaagaccaaacgggtgaattagggcatggcttgtttggggaatagtaagtgttcaggccaccaggatctcaatttggaagaaggggaacaagaaaccacactggggaagaaagatgccaggtgatgtcagagagttagaaagagaccagctgccaagagctttgtaaatgcatgtcttggtttgggttcctttggaagccaacagtattagttcattttcatgctactaataaaggcatacccaagactgagtaatttataaaggaaagaggtttaatggactcacaggtcctcatggctggggaggtctcacaatcatggtggaaagtgaaggaagagcaacggcatatcttagatggtggcaggcatgagagcttgtgcaggggaattcccatttataaaaccatcagatctcatgagacttattcactaccacaagaacagtatgggggaaactgcccccatgattcggttacctccacctggcccagcccttgaaacatggggattattacaattcaaggtgagatttaaaccctatcaccaactctgaggcaaaggttcaagtacaggtagattatctggatgatgattccaatgagtaccagaagagaagagggcaaagatggtaaggtcatgaaaagaggtagtattatcaaacacattactactgtgatcagctgcagcttaatcaccctggggacgaattctgtgagccaggagaagacacactcctcagaattatcccacctgagatgttaggaagctggggtatttaatccaatcatgcccatcagtggttgagggatttccctggggcattaatcctccagcacatctgtcttacctgctggtgggcagagtgggctcaggccaccagagaaagctctcaggcaaagaaaaatgaacagtgactatggaaagtcataccagaagatattacagtggcaacaaatatgggcagagcttcagtgggatctgttgcagcactaaagtggttggacactattgcaagggagattagcaaacagggaagagtctaagaaaagagttttaggaataattttcaattttgaggtagatcccttcatgtgaaataaagattgcaagggagagccaggattcactaggaccaaatgggaagcag

SEQ ID NO: 17724 - DNA, 98439 bp, Homo sapiens
ccctgggagtgagggggcctaggaaattcaggatattggtgaaaggatgacaaaatccactaaggatgcaagggtcattttcagagttataatttttaataaaaatgaatgtgaccaagtcatttttattaagttcatgaaatgaccacttttctcctctgataacaaaaaacataccaaagcataaagaagaaagtaaaaaatatgacctgcaaaactgccacccagagataatcatcaccggtaacatttggggatatgtctttttgagtgtggttttaacacacacacacacactctctctctcacacacacactctcttacacacacacactctcacatacacacacacaaactcacaaactcattttaatttttttgccataaaactaggatgtcctttcatttaacaatttacaatacatcttgggctactttccaagcccataaatatagatctgtgtcttcttgtttttttttttgtttttttttgtttttttttttgagacggagtctcgctccatcgcccaggctgtgtgcagtggcacgatctcagctcactgcaagctctgcctgccaggttcacgccattctcctgcctcagcctcccgagtagctgggactacgggcgctcaccaccacgcccggctaattttttgtatttttcagtagagacggggtttcaccgtgttagccaggatggtctcaatctccttacctagtgatccacatgcctcagcctcccaaagtgttgggattacaggtgtgagccaccacgcctggccttttttttgagacggagtctcgctctgtcatccaggctggagtgcagtggtacagtctcggctcattgctacctctgccttcccagtagctgtgattataggcacctgccactacgcccggctaatttttgtatttttaatagagatggggtttcaccatgttggccaggctggtctcaactcctggcctcaggtgactggcctgcctcgaactcccaaagtgctgggattacaggcgtgagcccccgcacctggcctatgtccccatttttaatggacatatattccattgcattcctcctgcaccacaactgcagagtcaaatctgctttgcttggctattaggaacatggttgcctacacccatttcctgtgagtgttcagtccaatccgccctctcctttgccttatgcgcctcccaatggcaagcccttccttcctgggtcacatgcttttctcttctagtggccaccagctccagggagcacagcttgcattctaactggatcctgcgggcaccgcgcagacactccgaggatatcgctgcccacactgtgcatactgtagacggccagtttcgaaggagcaccgagcacaggaccgtgggcactcagaggagactcgagaggcaccccatttatttgcccaaggctgtggaaggggccttcaacacctggaaatttaagcccaaagcctgyaaaaaagagtaagtgyttgggctaaatagcatgaccaagatgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctgggtctgcctccctttctttctggcccacttagcccatgcactgtgccatccaccttcatggatttccccccagtgccattgacgcatggcatgctacagacttttaatgagtttgaggttcaacagagcatagcaccaagaggaaaccaacatcaaatgaatcagatgcccctctctaaaatgcaccgggcaggctccaagatgtagaacgtcttgctggccaggcccctcttgggccatcttaccaccatctcctctggcctgtctccttttagatcctcctcccccaggcctagttaccatcactaaccgtcaaattcctgttatccactcgctcagagcagtaagctctttctgggtttgggcaacccaggccatgctgcagggccttgcctgtcacaacggaagggcctgtcaagcctcatcagctgtcttcctttgcttctacaaaagccactaaaccctgttggatttaggggctttctagatagcatttcccttccacagtaacagaccatgcactggacatattaaaatcacaacccagccctcaccacccgtccttccccttcaaggccaggccaaggtccagctgaggtccacccatggcccccatggcgacaccatttggtcctccccaagacccaggactagggcagcaatctgagggtctccatgagaatggtggtcattgagcatcccttccctctgtgtggccggccaagccgaacttaaacctcctgcctcattccttccttcwagcctggggagctccagacagatccttttcaacttctcaggagaagatatggagtgggatgcagagctctttgcgttggagccccagttgtctcctggggaggactaytatgagacagagaaccccaaaggacagtggctgcttcgagaaagactttgggagcggayggtgccctgactccatctggattccttgacgtgtctcagactgggtccctgagaagctgtccgctttcagcgcagcatgaggtatttggtagagttgaaaatgccaattgtaacccagtcaacccactcagcacactgcctgctggtgccgtgccagtgccaaacagacctgtggcttcccaggggacaggtctcaggacactctcagagcttgagtttctctgcgtgggctgatgaccagggacttacagcctggctggtcttcaagagctgaaggaatggaaggtcttgagtggagtgtctgggctcactcccctgacctcacctggcctggtcctcattctccacgtgtctgtccaggtggctgctagcaatgtgctcagtaccagaaatgaactcacctgtagatttctgggccaaagcttcaaagaggtagctcctctttctatgaggctcagagacatgctggatctgcactgaggttgccgtcttgtgtgcagaatgcagttgagaaagcagctccttttgctctaactcttttcagagttttccagaaactcctgctgcattaagctaagatgaggctaatgccctggcaatggggtgagggaaggggtatgtcacgagcctgcctgggggccacactgtttcctcaggccccaaaactcagctccccttcacataggcaattgacaagagaagaagggagatggggtgattcttttctttttcttctaattcttacccagaaaaatctttttaaatatccatggaaccagtttatgacaggccacacctttccctttccccagttaagagaacaatcagaatcattacgttcttttggtatagaaaggatttctgtattttaggaactatctgaatcagaattacatttaaaatatattctttgtatttctaaatactttttacatttttgcaatagttgtacccattcaagcttgagaaccactggtttggagaatatactgaaatttatctattctcacttctttttttggcattttcttgtaaaccagtctgtgcatgtataagggtctttgggcagaaggaagggagagagacaaaaaacagaaaacaaaacaaaacaaagaaaaccacaatcatttgaattaagccaaggatgttctaggctaaggtcaggctaagaactgaacagaggcttcctttctgccatgcctgtgggatgatattcttattgttccattttttaggaagaaccttttgtttatgtgaacctgatcatatgaatctaagaatatgtaactcttacaaataaaaaacagctagtaattatattgcattcttagaaattttatctcaacatgttttcagaatgaaaccatactagaaatgttttaatacctctctttattatttttcgagtgccaatgtcaatgtttggaaagtttctttcattttgttgcttgtactaacccagctatagccagaagcttgactggaaagtaaatgtttaggagatttgttttataaactgcattaaagcactgccatttatcaccacagatcttttattttccctaaatgtggccttgtttgaagcctcatctataaaagttcattgttggggataaactcaggataaaggtgtctttactctgcctcttatcaaactacagtttatcatagatccaccctgaaattatgtggtgaagatactgtgtacattttgtttttaaagataagaaaaaataaacatgactgcgaggatgtttggagtcctgatttttttaaaagcatttattgcttatggcacatgaagctgtgccgtcttattttgctttgttttgtatgttttttgtctttcatgagactatacacagcctgaaaaattccatgattgggaaacagaaggttgtcttgtctttggggatcatttttaggtgtttgaagttggtgataaacccaaggatctgtgctctgcctggggaatcttgagatggtgtctggtggggtttgagataaatgaaatctgaaacaataaaagtcaattcagaaaacccagttgagttgacagattcttttcttccttggattggccagttattcaatggaatcaagctgatcactgaggctatgttagatctctggctttcccaggattctcagttttgatacatgaaaatctacctatccctagacagaatgtcaaaaagagaggatgtgcatccgtggcatctggcttgttttttagcacctggtttctagctcccgctacagactgtcttctgcttcatggggcaagatgcatggagctgctagtttgatttgaatcgtgtgtacccagccatgtgccatgcaactgagagcattgctgccaagaccgaccttcctggtgcccattctcagacacagagcccaaagtgtctctaacaggacactgtgttcctctcaccactgttcgcctttgcagagagaatgagtttcctgttgctgctgtaataaattaccacagacttaaaggcttaaaacaatatatatttatgcttttacagtctggaagtcagaagaaccaaaatcagtttcaccaggttaggtcaagatgttggcagggctgtgttccttctggaagctttagaggagaatccatttccttgcttttttcagctttcaggggcttcctgcattccttggctggtgaccccatccttgcatcactccaacctattgattccatcatcacgtctccacctgctcagtctgtgctcctgcttcccatttataaggattttttttttttttttgagacagagttttgctcttgttgcccaggctggagtgcaatgggcacgatcttggctcaccgcagcctctgcctcctgggttcaagtgattctcttgcctcagcctcctgagtagctgggattacaggcatgtgccaccatgcctggctaattttgtatttttagtagagacggggtttccccatgttggtcaggctggtctcgaactcctgacctcaggtgatctgcccaccttggcctcccaaagtgctgggattacaggtgtgagcctacgtgcccggcccatttataaggatctttgtgattacatcactctcacctgagcaatctctccatctccaaatccttaatttaatcaaatctgcaaaatatcttttgccatataaaatgacattcacaggttctggggattaggatggaaacatctttgggaagccattatctagccaaccatacagcatcacaagatgttctagtcctaacagacccagcccaattcccttttaagcttcattataaaagcccaatattgggaggagccaagatggccgaataggaacagctccggtctacagctcccagcgtgagcgacgcagaagacgggtgatttctgcatttccatctgaggtaccgggttcatctcactagggagtgccagacagtgggcgcaggwcagtgggtgtgtgcaccgtgygcgagccgaagcagggcgaggcattgcctcactcgggaagcacaaggggtcagggagttccctttccgagtcaaagaaaggggtgacggacggcacctggaaaatcgggtcactcccacccgaatactgtgcttttccgacgggcttaaaaaacggcgcaccacgagattatatcctgcacctggctcggagggtgctacgcccacggagtctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaaggcagcagtaacctctgcagacttaaatgtccctgtctgacagctttgaagagagcagtggttctcccagcacgcagctggagatctgagaacgggcagactgcctcctcgagtgggtccctgacccctgacccccgagcagcctaactgggaggcacccccccagcaggggcacactgacacctcacasggcwgggtactccaacagacctgcagctgagggtcctgtctgttaaaggaaaactaacaaacagaaaggacatccacaccaaaaaaccatctgtatatcaccatcatcaaagaccaaaagtagataaaaccacaaagatggggaaaaaacagaacagaaaaactggaaactctaaaaagcagagcgcctctcctcctccaaaggaacgcagttcctcaccagcaacrgaacaaagctggatggagaacgactttgacgagctgagagaagaaggcttcagacgatcaaattactctgagctacaggaggacattcaaaccaaaggcaaagaagttgaaaactttgaaaaaattttagaagaatgtataactagaataaccaatacagagaagtgcttaaaggagctgatggagctgaaaaccaaggctcgagaactatgtgaagaatgcagaagcctcaggagccgatgcgatcaactggaagaaagggtatcagcgatggaagrtgaagtgaatgaaatgaagtgagaagagaagtttagagaaaaaagaataaaaagaaatgagcaaagcctccaagaaatatgggactatgtgaaaagaccaaatctacgtctgattggtgtacctgaaagtgacagggagaatggaaccaagttggaaaacactctgcaggatattgtccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcattttctttttttttttaacattgataaaatactattatctaaaccacaatccctatatacagagttcatccattgtctcaacgatgccctttgtaagtaattattattctggttcaggatctatcatcactcagtacatttagttgtcctctttagatttatttaatctcaagtattttttttttttttttttaattgatcattcttgggtgtttctcgcagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcactttcagagagcgcagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccataaaaccgccactgtcatcatggcccgttctcaatgagccgctgggcacacctcccagacagggtggtggctgggcagaggggctcctcacttcccagtaggggcggccgggcagaggcgcccctcacctcccggatggggcggctggccgggcggggggctgacccccccacctccctcctggatggggcggctggctgggcggggggctgaccccccacctccctcccagacagggcggctggccaggcggggggctgacccccccacctccctcccggacggggcggctggccaggtagaggggctcctcacttcccagtaggggcggccgggcagaggtgcccctcacctcccggacgaggcggctggccgggcagggggctgaccccccacctccctcccggatggggcggctggcctggcgggggctgacccccacctccctcccggacggggtggctgctgggcggagacgctcctcacttcccagatggggtggctgctgggcggaggggctcctcacttctcagatggggcggttgccaggcagagggtctcctcacttctcagacggggcggctgggcagagacactcctcacctcccagacggggtcccggccgggcagaggcgctcctcacatcccagacggggcggtggggcagaggcgctccccacatctcagacgatgggcggccgggcagagacactcctcacttcctagatgggatggcggccaggaagatgcgctcctcacttcctagatgggatggcggccgggcagagacgctcctcattttccagactgggcagccaggcagaggggctcctcacatcccagacgatgggcggccaggcagagacgctcctcacttcccagacggggtggcggccgggcaaaggctgcaatctcagcactttgggaggccaaagcaggcggctgggaggtggaggttgtagcgagccgagatcacaccactgcactccagcctgggtgccattgagcactgagtgaacgagactccgtctgcaatcccggcacctcgggaagctgaggctggcggatcactcgcggttaggagctggagaccagcccggccaacacagcgaaaccccgtctccaccaaaaaaatacaaaaaccagtcaggcgtggtggcgcgcacctgcaatcgcaggcactcggcaggctgaggcaggagaatcaggcagggaggttgcagtgagccaagatggcagcagtacagtccagcttcggctcggcatcagagggagaccgtggaaagagagggagagggagaccgtggggagagggagagggagagggagagggagagggagagggtcaacccagaatctcatttccagccaaactaagcttcataagtgaaggagaaacaaaatcctttacagacaagttaatgctgacagattttgtcaccactaggcctgccttgcaagagctcctgaaggaaacattaaacatggaaagcaacaactggtaccagccactgcaaaaacatgtcaaattgtaaagaccattgacgatatgaagaaaccgcatcaattaacaggtgaaataaccagttagcatcataaagacaggatcaaattcacacataacaatattaaccttaaatgtaaatggactaaatgccccaattaaaagacacagactggcaaattggataaagagtcaagactcatcagtgtgctgtattcagagacccatctcacattcaaagacacacataggctcaaaataaagggatggaggaagatctaccaagcaaatggaaagcaaaaaaaaaaaaagcaggggttgcaattctagtctctgataaaacagacttcaaaccaacaaagatcaaaagagacaaagaaggccattacataatggtaaagggatcaattcaacaagagctaactatcctaaatatatatgaacccaatacaggagcacccagattcataaagcaagttcttagagacctacaaagagacttagagtctcatacaataataatgggagactttaacaccccactgtcaacattagatcaacaagacagaaaattaacaaggatatccgggacttgaactcagctctggaccaagcggacctaatagacatctgcagaactctccaccccaaatcaacagaatagacattcttctcagcaccacattgcacttattctaaaattcaccacataattggaagtaaaarctcctcagcaaatgtaaaagaatagaaatcacaacaaactgtctctcagaccatagtgcaatcaaattagaactcaggattaagaaactcactcaaaactgcacaactacatggaaactgaacaacctgctcctgagtaattactgggtaaataacaaaatgaaagcagaaataaagatgttctttgaaaccagtgagaacaaagacacaacgtaccagaatatctgggacacatttaaagcagtttgtagagaggaatttatagcactagatgcccacaagagaaagcaggaaagatctaaaattgacaccctaacatcacaattaaaagaactagagaagcaagagcaaacaaattcaaaagctagcacagaaaagaaataactaagatcagagcagaactgaaggagatagagacacaaaaagcccttcaaaaaatcaatgaatccaggagctggttttttgaaatgatcaacaaaatagatagactgctagcaagactaataaagaagaaaagagagaagaatcaaataagtggcataaaaaatgataaaggggatatcaccacagatcccacagaaatacaaactactgtcagagaatactataaacacctctacgcaaataaactagaaaatttagaagaaatggataaattcctggacacacaacaccctcccaagaataaaccaggaagaagttaaatctctgagtagaccaataacaggttctgaaattgagacaataattaatagcctaccaaccaaaaaaagtccaggaccagacggattcacagccgaattctaccagaggtacaaagaggagctggtgtcattccctctgaaactattccaaccaatagaaaaagaggaaatcctccctaactcattttatgaggccagcatcatcctgataccaaagcctggcagagacacaacaacaaaaaagagaattttaggtcaataaccctgatgaacatcgatgtgaaaatcctcaataaaatactggcaaactgaatccagcagcacatcaaaaagcttatccaccacgatcaagttggcttcatccctgggacgcaaggctggttcaacataygcaaatcaataaacgtaatccagcatataaacagaaccaacgacaaaaaccacataattatctcaatagatgcagaaaaggccttgaacaaaagtcaacagcctttcatgctaaaaactctcaatgaactaggtattgatggaacgtatttcaaaataataagagctatttatggcaaacccatagccaatagtatactgaatgggcaaaaactggaagcattccctttgaaaactggcacaaacaaggatgccctctctcaccactcctattcaacatagtattggaagttctggccagggcaatcaggcaagagaaagaaataaagggtattcagttaaattgtctctgactgtctacattcagtcaaattgtctctgtttgcagatgacattactgtatatttagaaaaccccattgtctcagcccaaagtctccttaagtggataagcaacttcagcaaagtctccggatacaaaatcagtgtgcaaaaatcacaagcattcctatacaacaacagacagagagccaaatcatgagtgaactcccattcacagttactataaagagaataaaatacctaggaatccaacttacaagggatgtgaaggacctcttcaaggagaactacaaaccactgctcatcaaaataaaagaggacacaaacaaatggaagaaaattctatactcatggatgggaagaatcaatatcgtgaaaatggccatactgcccaaggtaatttatagattcaatgctatccccgtcaagctaccactgactttcttcacataattggaagaaactacattaaatttcatatggaaccaaaraagagcccgcatagccaagacaatcctaagcaaaaagaacaaagctggaggcatcacgctacctgacttcaaactatactacaagtctacagtaaccaaaacagcatggtactggtacaaaacagagatatagacaaatggaatagaacaggggcctcagagataacaccacacatctacagccacctgatctttgacaagcctgacaaaaacaagcgatggggaaaggattccctatttaataaatggtgctgggaaaactggctagccatatgtagaaagctgaaactggatcccttccttacacataatacaaaattaactcaagatggattaaagacttaaatgtaagacctaaaaccataaaaaccctagaagaaaacttaggcaataccattcaggacataggcatgggcaaggacttcatgactaaaacaccaaaagcaatggcaatgaaagccaaaattgacaaatgggatctaattaaactaaagagcttctgcacagcaaaagaaactatcatcagagtgaacagrcaacctacagattgggagaaaatttttgcaatctatccatctgacaactggctaatatccagaatctacaaagaacttaaatttacaagaaaaaacaaccccattaaaaagcgggcaaaggatattaacagatgcttctcaaaagaagacatttatggagccaacagacatatgaaaaaatgctcatcatcactggtcattagagaaatgcaaatcaaaaccataatgagataccatctcacgccagttagaatggttatcactaaaaagtcacaaacaacagatgctggagaggatgtggagaaataggaatgctcttacactgttggtgggagtgtaaattagttcacccattgtggaagacagtgtggcgattcctgaaggatctagaactagaaataccattagatccagcaatcccattactgggtatatacccaaaggattttaaatcatgctactatagagacacatgcacacatatgtttgttgtggcactattcacaacagcaaagacttgtaaccaacccaaatgtccatcaataatagactggataaagaaaatatggcacatatacaccatggaataccatgcagtcataaaaaatgatgagttcatgtcctttgcagggacaaagatgaagctggaaaccatcattcttagcaaaatatcacaaggacagaaaaccaaacactgcatgttctcactcataagtgggagttgaacaatgagaacacatggacacagggaggggaacatcacacaccagggcccattgcggggtgggaagcttggggagggatagcgttatgagaaattcctaacgtaaatgatgagctgatgggtgcggcaaaccaccatgacacatgtatacctatgtaacaaacctacacattgtgcacatgtaccctagaacttaaagtacaaaaaaaaaaaaaaaagtcaagagccatgggccatggagagagactcaggccgagggaataccatgcaaggcatctgtgctagagggagtatggctcatgcgaggcagctccaagatggccctgactgatctgtagtgcattactgagcacccgtatttgccaagcactcttctaggccctgaaggcagaataggaccagatcccttccttcagagattttaaatttgggggcagaggtgtataggcaataagtagtcatctatgacatgcatatatatttacgtagaataaagggccgggggtgaaatgctgtgaagtctggtggagaaaggcacagagtgtagagaggcggaaggtggggagttcagtcagtggaggcctctcagaggtggtgacactttaatggaatgaaatgggggattaatggagaccagaaggagaactgcccaggcaaaggaccaggaggagaccaggaggagaactgcccaggcaaaggaaggctccatgtgaaacggcatcaagggatcttgaggagaaggaaggaaggtgcccaggagtgctcgagggttctgagcaagggaataacacaatctgatcacgtttttaaaagatgattctggctgttgggtgaggttttgactggggatgggggtggggtggggacagctgttgagcagctctgtagggtcctgagggagtagcttgatcagggtggggatagggaagtaaccaaagatgattggatttaggatcaactctgaaggagaaccttccagtatttaggtttgctgtgaattcgatatggagacatgggatcgtgatagaggttccctttattgagttgaatgagggatgggctgatgggcaggggtatttggtggcgagggaaatcaagagatctattttaggtatgtttacttagagctttccgtagacctccaagtagagatgtcaaatgggaaattaggtatctttgtgtagagctcaggggaatggcttggtctagggtgtaatcccggggccatcctcgcagaggtggaatttgaagccacagggaggtgaggtcacctaggtgctgagtggagatgtaagagggaggaagctgacacctgaggcctggagtaccccagcatgcagaagctaagcagaggaggagcaagcaaggttcgagaaagagtgggccaatgagcaggaagtgctccaagggtgcggactgagcccagagggcgagaggggaagcggcatgggagaccggcagggttggtggagcaggcttcacagccaggtgagaaaaacagtctcaattttkattcaaaatcggactgtccacagctgaaagctcactaacctgtctcatgagacccagctctgcactccttctgactgtttctaaaactcaagccctgctgagagacagttgcctgtagcagaagcccacgggcagctgaagtgtcattcatgacttaggtgctcctttcactgagtggtctctggcctgcactgggtgggagtgcggatggactctggatcccgagtaccccctcatgcaaagaaaaaactacccagcctcaccctgtctcacacggtctcatccaagctgcaggcctgaggccctggctgtgtaaaagtgggcagatgatttaggccctctacgccttatttttctcaaatgggaattgggcacgataataacatttcctaacatatagtgtcatggtgaaggttaaatgaatttacacctgttaaagtgcctggtagatagtaactgttaactattgtcataatgaaagaatgttgatttgctatcacttaggatattcaaaaattgtgccacacactctgaaagtagctgtaaaagagaaattctcaaaatgtttcaattggaggaagtacagtctcctgagaaagctgttttgaagaagacagcactgcaccgacttgtggttaagattgggctctgtaggcaggaggtctggcttgaatcttggttcctccacccaccggctggatggccttgaatgtgctactcgcctgctcccagccccagcttcctaactgtaaaatgaacaaagctcgagtgcctacttcatgggaccctcatgagcacctgatagcataatgcacataaagcccttggcctggtgtctggcagagtaagcacaataaatattcagttcatattattattattattagggctctcaaaatacataaatctgcaagttacattcagttggttacaatgtaacaatccttttttgtcatgcctccttatatatagtccccagatcacctggtttatttgcaacttttcctttatcaaatggaagtatagattaggttagatttgaagattgttgactttggtcttgaggagcccttacctsgagtgccagtgttgcgagacctcacctccattcttgcctgggttctgtacataatgtacaaagtcagatgtatattctctttgcagttctgggaccactgcacctggagaaggttgtagcctcattttacactgaggggcactatcacttgggaaagacagaggactttttcatgattactccagacctcaagtaccagttgcagggtgaagactcagacttgagcccagtcctctgagccatgatcctgcacctggtcaggatttgtgagtcttcagagccacacacctcctgcctcccttcctgcgggaatgacttacacagcgtcctgttggcatgtggggctttggccacacggtggcgctttacgctcagcaatcccgctggtcctcttaatgcatcgctgaagatttgaaaatcaaactgaaaaggaaagagccctgccctctagttcttagaatacacagatatcattgtcaacgagtatggggccgttagcaattgaggaggtgagctgggttcactagctggttaccaccctgtaggaaatgcctcagttcttgctggtttcatccatcctaaggggaaatcaaaggacctcttgtctgaaatcaaaggattcagaattccacattcagagcccattttcaggtgtttttcacaacattgtactcaaccacatgtgtgaatcaaacctcactttccagtgtggctgatgaaataaaatgggctcacataagccagagttttgacattcctggaaaaagagattttttttctgaagatattgtctgactccaagacaggcctaaacctcttccagaaaaaagagaggggttaacagcagctagttttattcttctcttgaaggtgatataggacataggcctggttgtgaataccagctctgacactaactagttttggagcctcaaggaagctacttcatgtctcttcacctcaatgctcccatcagtcaagggtgtttatgataataggacctacactataggattgtggtaaggctgaattaatattaagtagaacsaaatgcaagtggttcagttcgttcaattctaaagtctttgacctgtaaaaaatggcaatttcatgtggctcattctaaaacatggaaagtgctttgtgccaggcatattgtgaggcttggtgaaagtgagtgattattattacagctggcatgaaaagagtacaagcacttactatgaacatttaggaaaacaaaccgccctgtcttctggttatttttttcctgaagattcttactgatagctgactcagttgttgctgcatactaaagtttctaatacgcaaatatgccaaaagagatctggctgtttatcatagctccacctttagccaggttatcccagcctcaagacatctttcaatgagatattaatcctaccaagggagaaaactcaaggccatcccagtaccacctgccacacgagtaaagctgaactctttcattctgtgcctctgcggtccctaggtgatggagacctccctctgcagagcctgcctctcagagagcactctatgccttggactgatgtggaaattgatcctctcagtccctctgaagcacacacatcaaagttgaactgttctatgtccttttccttcttaggtgaatactagctaatctgttyagccaaaggaatatatttttattctgtcagaagtttcccaagttgtagctaaaaggaatgagaatttcagagacctggcaggcctgggggggtggggggtgggggcgtattttttaacagacaggcctctgggagcccagcttcagccacaccctgtcttgtgtccggggacaccttcctctgctgatgtaggccttgggaagaaagccagcagcggctcagaagccaggcagtctgaggtagactgggggcaacaaatcaaccacaggaaaggcttcctaccaggaatgaggcagctgcgttcccagaaatgcacaaacaaaccaccaaaaaccagatcagggtyctatcttcctctcagacactcttaccttgcattctccctctagtttctttccttaaatgatagaggtttactccagcgacctcccaatggtatcccgccctccctgcaagtccatgaaaaataaaagatttgtgtttctcatcgcacatcatacatagaccacgggagatgagatgtggcttattggatctcatcacttatcacaggacacgcatcaagcgagactgtgtttacatacatgttactaatttggggaatggtgtttgaactcttcaatgcaccaaaagtgagttaacaagttaagccaggcacaacagagaacagactgtattcacgtgaagttcaagagcaagcaaaactagtctgtggcgataatatgatagtaatcggaatrggggcagctgrgggtggtaggactgattgagaaggggtaccggggaaatttccatgaccacagagatgttcyatatctttattagggtgtgagctacacaatagtgtacatttgtcaaagatcatgaaactgcgcacttaatatagaaaaaggtaacagcgaaaaatatccctcaaaacaacagtcacagtatcggcagggaggtccattatgtcatggaggagagaaggggaatttccatatagtgaaatttcctccctggctgtctatgcarttgaaaaacatataaaacgtcagccaattttccagacagtttcaaaatctagggactttttttttttttttggtacaagcactgtctatgtcttttcaaatgtttacagagtatttacaaaaagtagtccgttgggtggcagttgtaattagggaaactggcagtgaaaattaacacataccataaaagagggataattactccactgtcatatacaatattattatcaaatggtattcacccaggaatccaattggttcattcccactcagcctcgttgttacaggaaagaccctcccttccttgttaccctggttatgaagctgccacgttccacgggtgatatgccatatggtacttaacatcagaatcaaaatgagcttgtgctttttgtgtgagatgttgaaatttatcagaaaatcagaaagcctaatttccaccaagttcctgagaactgccatctgccgcatgaaaaagaaaatggagattttttttttttaaaccatttacttattgtgaaatgtgagggtgctggtgtatgtgtttgaaaaagcgggttgggggcggggagggggtttgtgagagagcgccagagcaagcccgcttggcagggcagaaagaaagagtgtcagctgaatggaggcaagggtttgcgaagcgtaattatggaaatcatctattcctgagcctttttttttttctcctcctgaccacatgttccttccacagaggagcagcacatagagtccagcttttgagaataagtaaagtccccatttcagaaagaagagggggctgaaaccagtctctccaggtgtcaagtccttctatggaggagctggcgtgagttaagcagggagagtaaaagcaaaggagccagaaaggctgagtggaaggaggaccaggaagtctttctaaggagagtgacagaaagaagggcaggcaggataggagagggaggccaacagcggagagtgaaggagtgcctactgagaagggaagaatctttcagcaaacttcggatgccaagggaaagatgctgaagtcttccaggagggcgtgcgatgcctggaygttcgtttcagtggacggccccagtctgtggcgttgtggtcctcgacagactgtcttaaccatgagtcacatccctctagtgccccacacctccacactgcctggagggcttaccccagcctttgattttactaaatgtatttatttgttctctgtttttacaccaaagctagcatgtgtgttggaacagctacaggcgacatttgttggacctggttagtggctggatttctcacctctgaccacaagtaatactcaggaaatagacctctggcaaacagcccaccagagcctgaaacggaacagtgatggggatggaggataaggctcaaggcaccaggggacttcccattatgacactgtagggccaagtgttggtcaaggcaggccgttcttggatggcatccaacgtggtttaattaaagatacactaaaaagatcactcaatagacagcctcatctacaaggcagtcttcctacaggagcttaggggtgtatgcttttctgtgcttgcagaaaggcgttctgtgccgttggcacctcrgggagaagcttcaggtttcaggctgaactcctgagagcttagcatctggggtgtgcacgacttggggtgccaggcagcaggtcccacttgctcaccagagggggcggccttatgctttaccccgcaggtgactgaggacccaacagtgtgctccttgctyggaggcyagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatggtgagcagctctcagcacccttggccctgactttccttccgcttctgtttgttgagcacctattgttcaaaatgcctgttatctaagaggctacagtttcctgagcgcttactatgtgccaagtacctcacacgtattacctcatttaatgcttactaaaaccctatgaggaagggaccattctcacccccattttccaaatgagacaactgagggtgagtaagatctggcttgagtcaaacagcaaataagacttggggtcagcaatgagccctcatggtctaacatcagaaccgttactctataaccccaacaaccatcctccaacacagcaaacggtattatgtccactttagctcatgagcagactgggctcagagaggttaggcaatttacccaaagctgcacagctacaagtcacagaaacagaaacccttctggctccagagcccaaaccctttctcctaagctgtactccctctctgggcttactgagactgcattttattttgaagccacattccccagccaatgcctggcaggcacggtgagtaggactggatatggaatgtgaaaacatctttacaggagaaagatttggctaaaccttaacattttcagacattttaattgcttctttggaacgcagatgtttttgggggtgctgcagccatggcccaagtagcctctgaaagatttgggtgtcaccagcaaatgagagtccctgcctgcttgctgatctcactggttgagcagcactagttccagatggttagagaactttggtgctggcttgccattcttacttatttcagtgaggccctcaaatgtgtagggagtgtgtcctaccaagtatccccctccacctgggtgtgggcagcaaacaccaaggtccccgcatatgctcgacacatcgtgtgggatacattgcctcttttgctctctccaggggcagagaaagtcacctgatttcagtggacaggaaagggacatgtttataatcagtagagggtgagggggccactctctgatctataagctcaaggtctctaaatgattaactctggtaccagcttggggaactgctgaacaccaaagacaaatgctggaccacatgactcaatggccctaaattcatcaaacagaggcacactatcggggtggtcatgacctagaagtaggtgatgtgkttatcaactagcagcagacttcaaattccccactgcctcagtttcccttgttacacactagaagtttgtctctagtgctcgggcagtgggcatgatgttttatttgattgggcatacttttgcaaagattgctaagttgaacaattgctatctttgtttacattggattgatgttgaataacgggttatttaaagattttcatgagacttgaggcttcatttcagtacttccttgctcgataagtgtttgttaaatacctcctgtgtagcagacagtgtcttggcactttagtcaaaatatagataaatgacacttacttcctgaccctgaggagcttgcaatttaacaaaggacaggaaaaaaatatatatatacatacacacatatgcatttatatgtgtacatggccacatataaacatacataatatatataagtatatacaaatacatgcacacccatacatacatgcctgtgtgtatatatatatgtgtgtgttgacagatacaaaacccgagcgtgtgcatgtgatagttaacacaccatctctgtggtgttgaggacacagaggcatccagcagtgagcctgacagggaatgatggctgggtctggcagagggagaggaaatggttctgcagaccaggcagtatcccagtagcctcagagcctggccttgccctgggctgactgggtgagaaaggaggaaactctatccattgaagaartgacatctctgtttggggaagggcggtaggcattttggatgagcctaaggcagcaggagtaggtgataaaatgaaacaaattaagacagttctagagagtgctctgaatgccaggctagggtgcgggcacatattggggagcgtagaggcgggacaagatggagtaaggagtaaggatgacattggtggtggggaactggaaatatagcccagtaggacaaatatttccatttctggaaaataactaccagagtttagacactcrccttcctgttggcactgggctctttcactttaagaaattcctatatatatgaaaatccaaacttataaaataaatctggagcctgatatttgtgtgacaaaagaattcttcccttcaggaagaaatattttgaaagctgagctcacacagtgctttcaaacataactcaatcaccctgcttgtgttaggagccccgagttgcggaaggcaggtggcctgcctggggcacactatccctcactaagcagaagtgttcatgggtcctccttttttttttytctgatggaggaagaagaaagagcacagattaatgagcaaacccagaasacagttctttctgttaacctggtgctgtctttcttattggagtttcctcctctgttttcctgcactcgttatattctccacacacacacccaggtatagattcatttttataaagaaaaaaaaaatcatcctgtcactgcctttttggaatcgacatgaagtgtgtgcccttcctttctgccaggtctaaacacctccatgccactggtgtgtttttgaattctttgttctaacaaaccagttccttatttcggagaggattataattgacagtaaatactttctttaactttctctaattacaatttgatttcaaatgtagttcatatgttttctatatagaaataacccaagcggtggggtgccaggtttttcctaagttgggaatgagcagagctattaaattaaatcacgagaaacaaggaaaaggtataattagtttctccaagaggatgccattgcacatttcctaaaagacatgaagatgtgtatgactggggatttcatgcctcataatatatatttttcttctggttttgtattctagtatggatttatcaacacctgtctgcaatctcttgtgatagagaaatttggtgaagaaacatgggaaaaattgaagtaagtatgtgaaagggaagatgaagtatctctggagcaactggtaagcctccagtgttttaaaggttacagctttttactgaccttttgattaagccagttagttgaatgaacccatcataaaagatacagctggttctcaaagagattcatttactagggagaccaattcccgtaccgtaaacatatgaattagatacaggaaacacctggtacaccttatctgtcttcgatgaaggtatcagtcttgattaccaaaatcagccttaaatgggatctcactgtaaataataccaacattattttaacttttatctcatgaatgaattctcattttctctttctaatcacagaagagagagcaactgcattatttccattgcacatcaagggagctgccaaacagaagaggggagataccttttaagtttgaccagaatcacttcttaggtgttctttggttaattcttagtttttctcctctgcctctgtccagtaaccccttaatgtcatcatttatatctccatatagtctcctgtctgactcttgcaatcttgtgctatctgtctgcttccctagaggctcccagacctaaagtgttagaagctggggatgaaagtgcctcagaaatcacttgatcctaggaagggagaggaaaacaaaaatatggaaaaatgattggcttcctcagttcatcaatgccatgcaaattaaaacaattaggcactgctttgcctattaaatctccaaaaaatttaaatgataataaccagttctggttaagatgcagcaaaatgggtaatcgctgatggcatagtaaatcagtgcagcccctttggaaagcaatctgacaacatgtaccaaaagctgtgcaaatgatcaaatcctttgaagcagtaagtccattcccgagaatctattctcttagaaatgcacacctttgtgcacacatatatgcatatatatgcaaaaagatataatgtagctttatattgataaataataaaataaaaattgtctttagtagttaaaaacaaaccaacaaacacatagaatgacaaaagaaatatgcatcatgatatagtgattgcaaagatcatgaagcaacttgcaaatttttatgacaatactgttaaaaaaaataagaaaaaaaccaaaaaagacacaagttacatatctactaggtaaattacacaaatgaaaaagggttaagagaaagaccaaaataataactaatagtgactgaattagataaaatgctggatgattttttttcctaacatctatttcccaaatttgctatgtttttattgcttttgtaatgtaaaaacaacttaaaatgcttaatgcaaactttccctcctcttcctcctacccccattttaaaaataaaataaatcgagctgagagcacagtgacttgccacaggtaggtcctgcccagacccatggccctgcacaggcctggtcactgcagcccactgctcacacacaggacaccatcaaccatcttattctcgggaaggcagcccaggggtaaatcagcatctctggggtaaattgcttacagctccacaagtttagatgggaaaaaggagctctggcctcatagaggcgaagaatattcatttccaaatattttaagtaggagcactgagtaactatgatcagggaaaccttggactcgtggacccttgagagattatttagcccagatcttcacagttgacaggtgaggaaactgaggcctagaaaggttaagtgacttggccaagactgcacagcaagggagcaacagggccaggatgcgctgtcagaaccttaaagtgctccttttcagccccctatgcggccgtgggaagagaagcatctgaagactttttcatttttttattttttgtaacagccattgcgttgtaaaggctaaactcagtaagaatagaggacaggaaagagcagtcttcttattttaagcacttactttcggccatgcctcttatataatggtcttttgaaagcccaacaagaacactgcaaggcaaggtattgccctgcttcaccaaagaggaaacagtcccggagaggatgatgctgaagactgcacagtgcataagggggctggggtggggacacaaatccaggtcggtaactgcaaagactcctttctattaggccattctacctggggaaaggaagagcaactggcaacgggaattcattttcttttttttttttcttttttggtgagacggagtctcactctgtcacccaggctggagtgcagtagcgtgatctcggctcactgcaacctccgcctcccaggttcaaatgattgttctgcctcagcctccccagcagctgggactataggcacccgccaccacgtgggaattcattttcaggggctctgggtgaaataagagaggtgtgtctttaaacatgtgtttactgagctcccatagtaggcctggtactaygaaaaacactggaggattgaagaagcaaataagccttttggcctggatggctttagaatctgtggaaacattacaggtatgcctggaacacaggaactagggtgctgaagggccatgtcagatgggaaactgggatcgtttcctctgctacaaacttgacaggggcaggtcagctccagccatgcacacctgggccttccagaggatcagctgctcctatgcagagggcaaggcgtcttaggaggaggaaggagagatggcaggctcagccaagctgttgggtggacactgcatggtggggtggggaaccaacttgggaaataggatactcatattctcagaaacacggcattgttgcaagtccttaggaagcagtcgttggattcagcgggggctctggggctacaatgctgaactcaaagcccagaagcaaggcctacagtctgtatgaccctggcatggcacttaaccactctgcgactcaggtatttcatctgaaaagaaaaataataaaagcagctaacctcatggggttattgcaagtgttaactgagattgatgatacaaaccaggcacttagaaaaaatgagtggcccaggatgagcactcaacaaatgcaagctgctgttgcataatggctgcttcagtgcttggtattggcttattttcaagatgctcgtcctcacgtgggttgggggagaggtggggggcagtggcgtgcgtcccactggactggatttgcatctgggctctrctgctcagagctgtgtgatcttgagcgggttgcttcacctctctgaagctctgtttcctcattgataaagggggaataatgtacctatcttctagggttaaggagagaattgagtggtgcaatctacacagaagtgcctagtagaaactcagtaarcatccttcctcctctctgagatataggtgctacattaagattacattatacttgacattattagaaccactttgctgctggtcagataatgatgctttccatcttgaagaagcagatattcctcaaaggctttctctttgcccagaggagaccttgcctcctaaagttagtgtgatttgctgaatggctttatctccactcctcatttcagtctgatctccctgacgcctagtgtgggccactgtctagccctgccttgaggaaccctcataaatgctagggaccaggccgtgaaggggagagatggatttttgttgattgatttttgacttacgaattttctaccatgtgatttcctggttaggacatttagcctcagctcagctgctgcttagaagaacctgtcctgcctaggagaaaggccagggctctggaaatcattgaaaatagccagaaatagccagagcacttagacatgagcagaggtaaaatgacatgttcagctctgcctacgacaggcagctgagatgtgttgtttaaggagggactctcaccctccgggtatgactgaacacagatagcatggccagctgctggaaccttcattggttgagatattcagcatatctttccaaatcaagggggaaaaaatctccagctttccatgtgtaagtggatggaagagactttttcctttttggatccttggtgcgacctctctgaaaggctggaatgtcatctctttcttcctttagaagagcagttctcatagcattcccaaacaaacaggaatccacatgacctccagggggataaaggacatttgaatgagggtacaagaatgcaagggaaccagagaaatatgtctgggaatagagaacccagcagggtacatcctgcgcttgtgtcattaggttttatctctttcatcttgaagyttcaattatctgcttaactgggtctcaggatgtttgtatacagagcactagacatctatacgattgcattggaaatgcatctttaagccaaaaataaagccaatctaagaagtccaccagctatgaaaattgcatcatattagaatttactaaaaagaaaaaagaaaaaaaaactagtgcagaaaactcagcttttaaaggagaaattaaggtgagattattggctgtgcaaaaggatttgcttaggccacatttaaataacaaattccctaatgcttttagagtagaatttcagctgagaaagaaaaaacccatcaattcctacagaaattttaagaagaaatgattaggtaaaatgaagcatgtttccagaccttatgacataaattttatcttaacatgaaataggaaacagatgtttctcctcctttgcttgcagtattttcctctcttatagtctagatttgtagatttctaattataaatcactcttttttttttttttttttttttaagagacagggtctcactctgtcactcaggctggagtacagtggtacgatcatagctcactgcagtctcaaacccttgagcttaagtgatccttccacctcagccaccagagtagctgggactacaggaatgcaccaccatgtccagctaatttaaaaaaaaaatttttttttttagagacaaaatctctctatgttgcccagtctgtttgtgaactcctggcctcaagagatcctcctgcctcagcctcccaaagtgctgggattacaggtgtgaaccaccgtgcctggcctaaattgcttgtttataatcttttggttaaaacctttattgaaatttaacaatgagaaggaactaatggattaggaagagtaaggcctttggaatcagataaacctttacattttgcctggatcacttacttgctgtttgacttgggcaaatgtatttattcaacaagtatttagcttctagaatgtgctgaacaaagtttcaggcactgggaatagaggcaaarggaataggcaagtgctgtgttccctgggaatgtattccaatggggaggacagtaaacaggcaaataaacaaataaatctcaggttgtgcaaagagctaaatttagagtatttagtggtgactgggcagagaagatgccagttgccctgagctggttagagaaaacctcttggcaaaggtaatgtttgaactgaaaggaaggaaggagtcagcctcaagacagagaagttatatgtgttccagagaaaatggcaagtgcaaaggtcctgaggtcagactgaactcagtgaagaaaaaaatctaacatgcttggaatatcatatgtgaggagtctgataggagatgaaggtggagagggttttagggatcaggacatataaatgtgtagaagatgagaaggagctgaacttttcttctaatgacaatgggttactgaagtttctgagctttggtgtggtcacttgtgaatggagataatcatggtgctcacctcatccacttgtgagcataggtgaggtggctaacatccccttggcactttgtttgcagaacttagtccaggattttacttccaaggatcagcaatccactatgtaagctaatgtttaaaggagttactataaagattcagaagactctaacagaactcaattgcaggaagtacagataaatctcagaggaaacagaaagtcagcaggtctgtttccaactctgcatctcccttcacgtttactctattttcctggttatctcttctctctgaaagtcttttgatttctgttccttttttttttttctgtcacccaggctggagtgcagtggcatgttcataggtcagtgcagcctcaaatcctgggctcaagtgatcctcctgcctcagcctcctgagtagctaggataagaggcacatggcactgtgcctggttatcttattttattttttggtgagacaggcttttgctttgttgcccaggctggtctcaaactcctgactttaagtgatcctcttgcctcagcctctcaaagtgctgggattacaggtatatgccaccatgattggacttaatttctgtttcttccaagcttttctatatgccctttggattcaagagatcaccatcatcagactggctcagtttctcagtgcctcaattgcagatgcctgagaaagagggtttgatggtctttggtctggagtccatatgtatcccattcagatggactttggagggtggggtctctaagaagaggtaatgggtagagccatcaggactgacgtatattctccattgtataaataaatacatgaaaacggaatgaatgattggatgattcatgtgtgtatgaatggaagatgaataaatgaatgagaggtggatggatgactaccaagcccaaccaacccatttaggagagaggtgggtgggattacatggcttctctctatgtcatgggttcttaaccaaaggttcatggataggcttgagaaggtctgagaaccctccgaagtcatctattaaaatgtcgtgtacatgtgactatatgtattttctggggagagggttcatagttttcatcagaatctctaagaactctacaatctaaaaaaaatcaaggaaccctgattatgaatccttgggatttttgttcttgctaaataggaaatgctggccgggcacagtggctcgcgcctgtaatcccagcactttgggaggccgaggcgggcagatcatgaggacaggagttcgagactggccgggccaacatagtgaaacccccgtctctactaaaaatataaaaaaattagccaggtgtggtccagcacctgtaacaccagctacttgggtggctgaggccagagaatcgcttgaacctgggaggcggaggttgcagtgagccgagatcgctccattgcactccagcctgggtgacagtgtgagactccatctcaaaaaaaaaaaaaaaaaaaaggctgttaacattgtgacatcctgagaagcattccttcgagcccagtatatcgcaaagctaattgagccagaaaaagtcagaattcattcattcccttttctgctatccctcgtccatccaattgactcaccaaatttctcaccctctcttcaagactgaaaacccctggccctccatgttatctacttttcccataaataaagtctagtttaaaagtagctgaaagcagagagtttttatttttaactttgatccaaaaatgttgcttgtctccccacttctgtccctttcctggccacaaacatttttgctggttcatctagctgcctgaaaccacagcccctcagagccagaagggcccttagaaatcaatctggtcagagcatttcacctggaggactcagcctccaaaagatcatatgagaatatctgtgggaaattctaaaaatatagtgaatattataatattaaatatacaaagcagaagtatttttttctaacaaaagctgtcaaaggtaaagcttgagaaatacttttgtttagtatgactatatggaagataaattttcttcttccttttttttttttttgagatggagtctcgctctgttgcccaggctgaaatgaagtgacgcgatcmtggctcactgcaacctctgcctcccagggttcaagctattctcttgcctcagcctcctgagtagctgggattacaggcatactccaccacacctggctaattttcttacttttagtggagacaagttttcaccatgttggccaggctggtctcgaacccctgacctcaagtgatctgcccaccttggcctcccaaagtgctgggattactggcatgagccactgcgcagggcctggaagataaacttagtaggagtagaaacagatatcacgaggcctgaagcttatataatttgggaagcctcctttaaaaagaatataattaccaataaaaatttagctacaaaaataagtactcttcttagaattaaggaagaaaactttaaagctgacagataacataaacatcaaaagctggaaacatgtttttattgttagtatcataaattaactaaccctcttttataatactttcctgcatctttggctgtattttgctttttctgttcattggacaatgattttataatgtcattttctataaagaggatagaatgaatattctagcatggctggctgaaaattgtatttattgtattttgttttcattgttagcttagacaaatttctttatgcacakccataactttctcagcagtttcttgctgaagtgtgcttctttcatgttggcaagtcctgggaaaactccagcgtttgatctccctcgacctgttccacccatctcccctacttttacgcaagtcctcttggaccaggcggtccccactgggaatgcgcagcctctctttcagatgcctttttgggggttagagtagagtctggatgtgtgttgagtctaccagaagcaagtggtcctgaggactgggtggtctgcagccccacccacaggcatccaggaccactaccagggcatataaggtgacccctcaggctggggatggcttcaagctagagggggccaggtgaggctgcttcctccctgtcctggaaacctcagcttcattagcttccaaagcaaacctgaagcactcttgatttaaatcagaagttcttaaacactttggtattcagaagcctttatactctcataaattattgaagaccccacagagcttttgtttaatctatgggtatttatggtattagaaattaaaacaaattaaaaaaacatttttaaatttatctaaaataattatatgttatataattatgctgtaatacataatagtacatgttagtgtaacatttttatgataactatattattcaaataaattaatgacaagatggcattactttacagttctggaaatctcttttaatatctgacttaatggaagtaatggaagtgggattccatcttccgcaatgtatgtattctgtgatatgattttggttgaaacttgtgaagaaaatatggaaggaagaagaatttaatactcttctcagataattgtggctattcttttaaacctcacaaaagcttgacaaatcgtattttctcaaaggtcagttataatgttgaatctgtaactgtactgatgaccttcttcgtactctgttatattaaaatctcttgatctgtgttacacttggatagaaattttttcgcatcattttgtactagcttgcatgagttatttggaaactattagctcactgacttgtgctaatcttacaaatgttgacatgtttcactatacaatatcaaaattgcatttgtcaatatcatcatcaccttagcctctaaggattgggatgctaataagcttacagtataagatgcaacttttttccccaaacttgagttttgtcattggcaacacattctgccagttattttccttgaagtgacaggctaactttgttattttcttaagagaatgtgtgccaaatatccaagtctgagtaaccatagttcgtctgtcagtggttttttaagtggaaatgatgttccattaaaaaaagtggctaattcatctcataactcaatcgtgtaagtacttttcctggaagtgaccattcacactcctgcatataggagaagtactttatttgagtgcgtacttcccattctgttacacaaaatattcaaaagatgtatactcagggtcaagatttcataacattagtaatttttactacctcaaaatgaacaacctaaagtaaaactggcatttttttttactgcacatatgtgacaatgagggatatgatgactataaataatatactgaagatttaaaaaaagaatataatagttttgtgccactgtcttgattcatgctataaggcaccaaattttactcaccaatgcttatgtgccattagtgcaaatatgaatcagtacaaaaggcaaataatgtcttaatttggttttgaaaatagtttggcctcatggattcctaaaaacaccttaggtattcgcaggggttccatgggtcatactttgagaactgctggcttaaatgccttaagcatccttctaagtgaatcagaggtcaaggaaggagacatcattggtggctgagggagagaaggggaggaccagacatgacagtcttcatgacaatgacctagttgaatactatctttgtaaaaatgaagaaatggaggcacagtgagatttgctccaagtcatccagctagatggtggtagagccagggttaactcctaggtctcctcctgacacacagagtctgtgagcctctgtcaagttaggtctctcaccgaaattatcttacaattatttattgagtacttgttgtgtgccaggtacagggctaggtattgaagatattaaatcaaatgacattgtcatgatccttcaacttggtagtctaggaagcatgcagatgggcaaatcaattccactcacagttagcacgaagacaggtgatacagagagcacggggggctcagagcagggacgcccggatctgcaagtggctgagaatgtccagaatcgggattctgacactgagttgggaaggaagaatcaagttagccagatcagggaaagtgagagcttttctagtggagcagagcctgtgggaaggcagggaagagaggagtttgagtagctggaggaatggatgtatgggataaatggctggaggtgaggagtgggtgcagaggctgggtcgtggaggctgggtatgtccacctaagaagtctagattttattaggaaagctgtggggagccagacaggctagctggaggacaggctagaaagacagtctggtgctttttctaaattccagatggttgtgacaccaggacaaatcttttgcctctctgggcctctctttccccaagtacaccttgagtcacacagtgacaggcaagtttgttatatgaattccccacctaccattaagagagctgttgaaaaaatgagttcctatggcttaaattgatcccattctcttggcctgaatcttgctacaaagtgctgttcatttttcctatgggctttatggctcaccctggactctgaataaccattacatcagtttagtaaggttgaaccacgtaaaatgtatcatttgtaacctgttgccttgccagactgaatcctaaaaagtgtttctgtgcagtggttttcaaacctggacagtcgtctgaggcgagtggttaaaaatatatggattttcagacactacctcctggggctcaggaatctgtgtatttattttgccctgtgagttgctctgctataggcagcctggccctgattttctgctcagatattttgggtatcgctagttggaactaactaaagaggaacatatattgaatgcctgctggtgccaattaaacactgattcctcagtctcctgcacatggatgcatacaagcacctatgtggctgacacttttcatgttccatgacaggtactcctctttgtgtgagctggaaacatctaactcttacttcatttcccacatttcttgcatctccaactcgatctcttcaaaatgctttccaatagtcatttttctctctttctcctctgcatatgagaggctctgtcatctcattggaagatatcaattggtttatttatttaaaaaaaattcttggtgaacatactgttttactaaagcagcttgaatgactacatatgcaagtgtgcactggctctgtgggaaatgttatatgcaggatcgtggagatcaataaacaaggctgaaaatccctgtataatcataacagtctgggcacgtctggcatcccagcaacgtgcaacatatatacaaacccaaataaatatttgacactaaaatatgatcagttcagcctacaggaaagaacaggctgccagatccagagattggtgaatgggtggtcccatcagagggccagggagcgccacagagtttgttacatttctgacggtcctggaggtcacttaaccctttctaaggtcttcagaacacattatgacaatgtgtcaagtttaaactggggtcacgtccacgtgtttctgttttgcttataggtgcagaaggagggcacatgttttcacagagacttgtgggcccctgggggcgagtaagaggcaactccaacatggtggagagtgccccacttaggcagcagtggtggtgtacagcactcctcgcccgagcaggcctacagccggtttctctgaacagctgcctccgaagatgcttagaaagcactgtataggcatgggccaaaacaggaactcttacaggtgaaggagaattcaagcagcttctagtcctagaagctasagtcctagatcctcaactgcgtgcacaagcgtttctggggctgtctgagaatccccagtggatgtgtgtgtagcagagaggttaaaaaagatggagaaacacraatcttgcccagtacctcctctattttacggataaagaaatcaaggcccagagggggaaagtggttttccctcagagcttatttgtgtaaggtataagcttggaaccaaagtctcctaaaccccagccctggtcacctcctactcactacgcagcccctttgttctcattgtcatcacagctctcctaggatctgcatggtggttctcattttccccaagctctttcagatttgttatcctgttttatccttaccaacactcctggcagataggaagggcaggtaataataattgccacattttacagagaggaagatgaagtccagaaagatgataaagagatagttaaatttagtgatgaataaggatcctcaaacattagaaggttaggtatccagaggagggaccagcccagtctgcattttcctaaagggtagaactaaggccagtgagtaaattcccagcagcacagtacaggagtggtgtgggctttgaagttcagagcccagatccttctcttgtcaaccggtgaccatagcaagacatttaatccctctgagcatcagccttctcaacagtacgaggaatgataagtaataaattggtcatctcttgggccaaaagcacatgcttaataaataggaggtattatgagggcccagaagggggtttcatttgaacataagaaagacgtttccatcaaagagagcagttggtaagtggaatgtgctgccttgcaaaggaatgagcttgttgtcactggaagcattcaagaagaaactggaaaaccagcagtcagaaatagcgtgcagtaagaaattggacatttagaaaattggayatgtagaaaattccatacttctcgcagtgtcaagattctatggtgtgctctggataagcttgaatrctctgacccctctctgttcttcaaacatgttctctgctgcctagaagcctgttctctctgtccagaaggctcttctttgcctttccatccttcagtctcagcaaaatctccctttcttagagaagcattccctgaccaacctccttcccccatttgttaactcagttgccaactacagtttgatgactcacataagggccaagccaagggtgcaagtctcagactcccaggctaagcctcttttcagcaggcttggctatctgttgaagactaaagtccatccataactcctgcaacatagccaactacactgcaaaacagtgagaaactcaagcagctgctctaccattcagagaacaagactctatgaccattgagttccagtttactaccatatattaagttctgaacatgtgctcagtacagtgccacttgctgggggttcaaagataaaaacaggtcacaatgctcatcctcaaggagaccagctagtgggtaagaccaacaatctttatataagttgaggaaatrcatagcctatcctgggtacttgagaaggggtctccgggctcaaactgaggtccagggaaggcttcttggaggagttgacacccaaacactccagtgtctcacattccttatgatcaagaagattattgttacattatatcttgctgggtcagtggatatattcctggggcaaagctccagctgatgagcattcactgcacctcgatttatcctccagaacttctgcagaagtacaagatgccttcatgacctacacaatgtatgatgacgtcatcaccattaagctcatccaagaggcctgcaacattctgggtaagtatgaaagaacttgttttgctttcttagagctgctgtaacaaaacccagttgattctcattatttgcattggttatagtctataaagctgctgcaatcctgaattagtgaatactgcaccattgttcctaggggaaatacagggttagtttcctgaaagtctctggtcacaagatttttgccaaccaatcaatgcataactttgtttcatgtgtgcttctgtgaaaaaaatacgtatttaatatacatagttgattcattcacattgaactgctggccaactgtactgtaactcatgcctgaaggaggctaatctaacactgcctgttctctggaaggatgtgacagtcttcttgtgcttagggacactagatggcacttcagcctacatttgggggtcattctaaacagcaaaatcaccaacagaaaagcagaaaaatgtgaaaaagatgacactaaatagactgcaagaaggacacttggttatagttcaaactaaaataagaacatagagcacagccttgttctaccttggctagaagcattcatgttggccggtggaaattctgtgtctgtgaatgaccttgatagctctgtgagtattgatttcgggcctacagataaataagtagccaaatttgtgaatatgaaatcctcaaataatgaggaccgactgtatcacaacctgggtggcttaaaactacagaaattcgttctctgtggttcaggggaccagaagtccaaaatcaggttgctggcagggccgtgctctctctgaaggctctcaggaaaaattctttccctcttccaacttcgggtggccccaggctttccttggctagtggcggcataactccagcctctgcttctgtcttcacgtggctgtcttctccctgtatttgtgtctctgtgtctaaatttccatcttctcattaggacatcaagcatattggatttagggtccatcctaaatgacatcattttaacttgattacccaatttccaaacaatgtcacattcacaagttcctggtagacatgaattttaaggggcactctaacccagtacagggctcaggtatgaccctttccatttgagtggccttaggcttcttacagacaaaaatgatgagcagcaccgtctgcaccactgccatcatgtttggcttcgatgttggctttacaggtgttgcaatacctttagaatggtctgctatgattatctctgggtgtcaggaggaacaacattgagaatccgcctatgccacctacactcgtgcttacctggaaatggacgtggggtgctctgcagtgtgctgagggcccttccccgatctgctctccatcgcatattttcccatctgcctggacatgaaaatgccattgacagggtcataggagggggaccatgtgtggatggtcccactgacaatgtacgtgtcctcccaggatggtttttcctgtggatgtattagcactggattttttttatcttgttaatctgctcactccccaggcccagaggggacaaggtacaggacaaaaaaaaaaaaaaaaaaacaagaaaaaaaaaaaagaaattagctctgcctctttctagtttaatgaccgaggacaaatgacctaaatagtcacagttttctcattggttgaacaagatctaatcttcagagttatttggaggattaaatgagaaaatatatgtgaaaatatcatatgtggtatctggcatataataggctttcaaaaaacattccctccctcccttcttccctcattccctcctttccctcactccctccctccctccttcccttcctttcttctttcttccttccctcccctttgtgtttcctgggctgctgtaacaaagtaccaacaaccaggtggcttcaaacaacaaacatcaattctctcccagttctggaggccagaagtctaaagccaaggtgttggctgggttcattcccctggaagctctagggataacttgtctcttgcttctctcccaacttctggcagttgctggcaccgcttagcctgtagacacatctccccaatctctgtccccatctccacaggccttcttccctgtgtgttcacgtggccttctcatattgacagcagcctttggatttagggcccaccctaatcccttatgtcctcaccttattttaactagctacatctgctctcttttcaaataaggtcacagtctgaggttctgggtggacatgaatttgggggcacactattcaacccaatacaccctcgctttctttatccttccttctcaccagcactgagtacacaatgagccagggcaggcctgaggggagggaggggcaggcagcctccaccgtcccaggctccagggatctatgcaggaagccgaagcccccctctgtacccaggatctttgatgaggttcctctttcccttcccgttgaacttccttcacccattcctcataggcggtgctgccttgggtcactgtgagagtgtgagatggcatttaaggatgatctcactcagacgctgcatcaggcctcatgcttgtcacctggcaccgggtatagccctgttggaagtgtcaggctaggcccagtccctgggagtgtgcaagctggctcttatgcagcctgcagagggtctggcagcaggggccatggttttgagttggtttcatggtgcctctgagggcctagcaaattggcttgccattctcaggaacaatttgtgaaatgatataggtttaagccagtagcaggtatcacagtcatcagcccagcaggcgtgcctgagaacacaccagggcagctagctaatgctaagcccgcagggacaggcagcttctccagagcgcagcagtgatgtgtaaagtgcccgtgtcgtgtgaggtattgagcttatttcccttccctttggatttcagaaaaattatctgatgattaaaaagatagtgccagctttacttgcaggcaactggatctgacagatgagagggcttttcccatggctttcacatggcgctgtgactgatatctacatctcttctcatgttcctggtcatctcctggatgcagaagaccttccagggatccatatccaggagaggcccaaagtctctgccaagctgggagggggaagtcattgaggctgaggaagctggatgtgtgtggtgctcagagtcctctctggtaacaggtggtcacctgcttcccctgcccactctgggccacctgcttcccctgtccwctctgggccacctgctgtctcatctcatcatgttgctctcttggagccacagagacaagcaggggccagagttgccaacgaggcctggcaggtgatggtgatcatagctaggaggaatctggtgtcccaactggttgttaaaacaacttccaaccagatgtatgttagcccctggtcacttcccacctgcatcttttgatagaaccaaggttgtgtctgaggctggaaataaggcacaaggagtgaaacagtcatttgctccttcagctcctggaactcaggcrccaagagcagcaacacctcccggatgcttcctaaagccagttcccagcctgccaccacggcagcacttagagggaggacgcaggcagctggcagacagggctcacgtggcttcccaagaatcacggctgggcctctccccgaatccaccaaccagctccgctctccaaagaagcttacagagagagattctaggccaaagctggcccaggaactgggaagtgtcagtgatacctgcaaacctcacccctatcctgtccagcctgtcttggggggactcccaggcccttttgtctctccagcagctaacaccaggggaggtttstgtggggctgggttatcaaaaagcacacagcatcgagctttctgcgctcgagtctgagagcgggatgtgtcctctttacagcactgtgctgctcccaggggctgcaggcctggagacctgggttctcgactcagctctgctccccagctatggcctttttgttcaacaggtggcagcagcacagccaccccagagggtcacctgtcagcctttatgcttgacacacctgccaaagagattacctgttttgttttcttaagcatcactttaattttttttaaaagtatgcgattacgatgttaaatatgcttttgcaaaccagacagamagatcccctcttgatcctaatatgtccaccccacataggcaaagcctaggtgctgcccttgtggctgacaattctgcacatctgtgatcctagtgagggcaggaggtccacgagcaagtccagtggtttgcaattacctcctttcttctagctaagtaagaggagcatctagtaaccttccttccacaggaagaatacaaatcattaggtggaaattctgtaatgagagatgactacttttgagctgaaaatctggagttttgacagagcttaggaaataaaacggcaaaaaagcttasaatgggtagtgaaattaagcccacctttagtcttttcttgattttattccaagggatcccagcagcagaaggacgtagtggctgtatcgtgtagtcttgatttggtctgagccctctgcgaaagaacatckcgttgttattccagaatgagaatggagggtggattcttttccgtcacaccagctgtgtgaccttgggctagaatttcactgagagttgatctcctgcaaaaggaataataccttacagggttgtgggaaggaatgaattaaatcaaataacaaatgtaaggcacttagcaacatgcatggcacatactgggtgtttggtaaatgtcagccaaatgttgaatctgaaggaaggatgggggtatttctatgttttgtacctctagatactgtcccttataagaagacaggctttgctgttcacttcaaatggctgtggtaaaaaattatgttccacatgtacacagggaggggaacaacacacactggggcctgttgtgggggtcggggggaaggagagcattaggaaaattagctcacgcgtgctgggcttaatacctaggtgatgggttgatctgtgcagcaaagcaccatgacacacatttatgtatgtaacaaacctgcacatcctgcacatgtaccttggaacttaaaaataataaaataaaataaaataaattatgggccaggtgcggtggctcacgcctgtaatcccagcactttgggagactgaggtgggtggatcacttgaggtcaggagttcaaaaccagcctgggcaacatggtaaaaccccatctctactaaaaatgcaaaaaaaaaaaaaaaaaaaaaaaaaaaaaaaattagccaggcgtggtggcctgcccctgtaatcccagctatttaggaggcttaggcaggagaatcacttgaacctgggaggcggaggctgcagtgagccaagatcgtgccactgcactccagcctgggcaacagagcaaggctctgtctcaaaaaaaaaaaaaattatgttctgagctctctgattagtggtcagcaaactacatacagcttatgggccagatctgggcccttgcctgtttgtgtaagtcacgttttattggaacacagccgtgcccctttgtttatacatcgtccatggctgcttttgtgttacagtggcagggctgagtagctgcgcagagaccatatgacctacaaagccgaaaacatttattatttactatctgcccttcacaggaaaagttggtcatttcatgctctcaagggtggatgcagatctttttcaagattctaaaaatatcttttaacctaagaactgctctggactgaattgtgcccccatgccccaaattcatatttggaaatggggcctttgggaaataattaggttgagatgaactcatgagggtggggccctcttgataggattggagctcttataggagagataccagagcactggctctctcactccctgtcacatgggaacatggtgagagggtgaccctctataagtcaagtaatcatgttatcaccttgatctcagacttccgacctccagaactctgagaaaataaatatctgttgtttaagccaccccatctatggcattttgtcrtggtggccctagtggactaatataagaacttgaatcagcttgtatatctccagaaagaaatactctgtatatatcatatcaccccagtccatttttgtggctgtctgtgctcatgtacatcaaacggtgtggcagtacctccagcagtgagatgccatcacatacctgccccactgccgtcacattcccaacccaaccaacatgtgtagaggcagcagccagtctacagaccaatgtgtgggctggcccacatcacctttccaccgaaagccaacgtacatcactgtggtttctctctgcctagctttgaatgtcaggaaycttttcttcttgtagtttatttccataacatctattggcctatatctatctgaaagagtaaatgagtatggtgaatgcatttttcaaacaagaagttgggatgcaaaatcgagtgaacacatgtatgrgatgtggaatcaggacagccccaggaagcccgtcgtgattctgtatgtctccaactcccatgagtctgagagagcaagacccatccaaaggaaaggctacaggaaggacattttactgtctaacaaaatatactggtcagttgaaaatcctccctttgacaagggaaaaagtgtgcttagtcaccactagtgagggctttgctttccatgtgggcttcagaatgcaatttccctaccttgaagcaattgctgggacttttccagaccgctctgccactgcatagctctgtgctttccaattagcataattcaggaggggaccagatggcaggttgagcattgcataaggaattgttctgtatatgaataagtgcctacttagtgtgtaagtgggttattagtgatctgaagcgacaaaattcaaaacaacacacaacagccatttggcacagctgtgtccgtctagactttgcttgcgaagacacccacagtaaaatgtgtttcaacagttagctatcagcaaatgccagcaagcctctctgcactcacatctttaaaaataagaacaacacaaaattgacaacgtcttgaaatcaggcattataacgtttgctcttcactattctcctctgaggatgggacaagtaacccaggctgtgcaaccagccacgaatggagacttgaattcaggtctgctgattccaaggctgatgcttaatcccacagactggaggggaagtcgacaatgtctagagcaagggctttggaatcagacggacctgggtgagccccctggctacaccggctcctgataatgtaacctggggtaaatgttcccctggtaatgcagcaatgatacctgtgacgttttgctcaccttatttgatttcttctgtaggacaacaacccagggggtttcatctgtcctacagaagaaatcaaataaggtgagcaaaatgcctgacaccgagtgggtacacaacaaggtacctcgccctgtccctcacccctgcttgccaccagatagacccctggccccctgctgtggccctggtagggctgactactctgttccaaggtttgacgggaaccaggaggcttcttctctaccaggcttcagcggaattgcttcatccctgcagagcaccaccttcctgagctgccttaatcgacttccagtttattttttctctgtgcctgtataaacttacgactacttctgaaacccaaccctcctaatttagagtcttcttcctccttgcaaactacagcatggacatgggcagatgtttctttccttttcttagactactctttctcctactccaaaatatttccccataaactaactcatgcctgacattagtgatatcattggagaaaaagagtatgtgagattctggctcttttcaggtatctgaagagtaatcctttggataccaacgctttgggggaaaaattacccattttcaacggaaaactttgtcaaatgtagagcatgtacttctctttcctgttgaagagcacatgttttgctgggtgactcaggaagagtgccatgaggaatagctcttgttgcctgtgacttgggtgacgggaggtgggcaggggtcttgcaagtctggccctgagtgggctgtttgtccaggaggctctgctttggtggctatggtgtccctgccagcctcactggggcttcaacaggcgctctctgtcccccagccctggacagcccaactctactctttccagtaccttgagctgaaacccagcaagaagcaaatgtttcccagtgacaaagaagacccatgcttgttaagtcagaaagtttgagttcatgcaacactccaatgtaaaagcttgttagaggtctccacacctggggaatcaagcatagaagctttgtgaccatcattttcctcctggaaaaaaagtcttgggtgggtgttgtaatcccagcactttgggaggtcaaggtgggtggatcacttgagcccaggagtttaagaccagcctggacaacatggcaaaacccccatctctacaaaaaatacaaaaattaaccaggcgtgatggcacacacctgtagtcccagctacttaggaggctgaggcaggaggatcacctgagcctggggaggttgaagctgcrtgagccgtgatagcaccactgcactccagcctgggcaacagagtgagaccctgtctcaaaaaaccgaacaaacaaacaaaaaaacaaacgaaaaaaacccaaccaaacaaaaaaaaaaacaaccaaccaaaaaaaactcaactcctttatttatttaaaaaaaatgttttaatacatacgcaaaagtagagagaattgtgtacagaagcccacataccctccacccagcttcactaattaacaatattttgccagtcttatttcatctatctgattcctccactctttttctagttttattttttctggagtgttttaaagcaattaccaggtttctcacaatttcatccataaatatttcagtattagtctctaacaagataaagacattaaaaatgtactgataatgccctgattataactaacaaaattcataacattacagaggcctgggctgcagctgtatttcagctggccatggataaacatggtctttacggtcttattatgtaagattccctatggtcttttcagagcaatcaacagaatcttttttactttgacataatttcaaacttgcaaaaggcttacaagaatagtacaaagaattcccatgtagtatttatccatattccccaaatgtygacattttaccatatagtgtctatccttctctttatatctagatttatactttttttcttgaaattgttagtatattgcaaatgtgatgccttcttgtccttaaaaattctcttaaataactacagtacaacaatcaaactcaggaaatgaacatagatatagtgctattatctaatctatagaccttattgagagttttccagttgacccartgatgtcctttagaacaaaagaaaatcctgaatcatgtcacttatcgtgtctcttcagtattcyttggcttggaacagtttctgagtctctttatgttttataaaattggtatttttggaaagttctggtcagacattttgcaaaatgtccctcaattgaggattatctgatattcctcatgatataattcaggttatgctttcctggcaggaagatcacagacgtgatctttttccttcccagtttatcatatcaggaggcatattccattcattgatctgtcctattattagtgaggctaactttgatcacttgatttacgtagaatttgccagctttctccactgtaaagttacattttccctttgtaattagtaccttgtgaggagatactttcagattatgcaaatatcttgtcatttctcaaactccctctttcatagttttagtatttatttgtgattcttgtctgaattgatacttatgatggaagtcaaatggtgattttctaagaatattattccttttgtatttattcattgagtttctgtaaggaagaatttccccctctcccccatgtatttatttacttatatcaatgtagatttgtgattcttattttttaaaaacaggctgtaatcctttccttttattatttattttgatgctcaaattgtgcaagagttagccagtgagagccaccctaaactggcccctgtgtccttttgacatgtccccatcattctttgatcacttctttaccttcttgcataacaagatgttataggctgatctcatcctttccctgccccagccctggaatctgccatttctccaaggccctgattccttttacaggagaagagcatttaaaaactaagatctagacattaggcaaccccactgctactgggatatcactgcttttaggccctcttagtggacagtgctggaaaatacatgtcatatacacacacacacacacacacacacacacacmyacacacacayacatccatctttctctctctatatatatatctatatatataatatatatctatatataatatatagatataatataatatatatagatataatctatatctatctatatatctatctatatatagatatagatatataaaatatagatatagatatataaaatatagatatagatatagatatataaaatatagatatagatatagatatataaaatatagatatatctaaaaccatgatagatttcattgtcttattatgttagattttctaatccagaggcacagggttcattctattcctcccctttccataattgtaacttcattctcagatagggaaaaacctggctcccactatccacaatatatttacttgttcagaacatagtttcagaattgctaacccacactgctgtgaaaaggaagcctactaactacagtaaaatatttgtttaaagttctttttgtttttggcctgaagacacagtagtgtaaatactatgttcaaatattactgggttaatttttttcctgggtgattatgttattcaaaactgttctgttgaaatgctgttctgtgaatttgtttctgtttgtactccatcttaggggttttctctatccttgttgatcttatattttatttattttaagcatatgaaacattaacatgactccccaaaccagaactgttcaaaaagttatgctcagaaaaatgtcattttccccaactccacaatttttctaatctttccaccccattccctaccaatgtcctgtaggtaaccaatctcaatagatccaggtttatccttctggtgtttaattttgcacaagyaggcagatagatgattatttccttgttttcccttctttcttacattaaagaatactaagcatagtataaagtctcccctgcactatcaraaaaacattttarggcrcctaagttagtttagttctttcttgcagtttctaaccatttcctgtatatcttggatcccctatgacttagcgggttcttggaatcttaaatacactgatgtgaaactgtataaaagactaaaacaggtgctgatttttttaaaaaagcggcctttattccctgctggacaagcattctcaactaagaattctagaagaagctccaaacccattacaggtggaaaacaccacactcaaacccaagatccttgtttgggaaacagttcatctctcagccagatgtcctttccttttaacagagctgggcatccacaaacaaaataaccagagcctggaacaaacagcttcatggattttttaagtttaaagatttgaaagtcaaacaggcagtctttyacccaaagctgccactcttacttgaatataactttgcttggcttacacgcagcccagtcctcctggcagaggttcttgggagaaggggggccgctgggacccctgcttttcctggcaggtaacaggatgcacctgctcagagctccagcctccaggatgcacagcacagctgttttttcttagtctgaataagctagatcagaggtaacagagggatggaagcaggagagcagaaggacaatttcccatctgtctgtttaccttttagcagtccccctcccagagactcaagcactggaaaggaacttggtagaatttgtctcagatcccctaggggttagcaggtggtccttgaatttataccagtgtatagacaagcctgcctgaggccggccaggatgcacccacaagcaaagaagccaacggaggcaattaacacaggccattaccactggcttctctaccatcccaagcttcgtctagattsagatccgactaatcaatttttggaaaatatgtataactcatcttggaaaatatgtacaactcatctctgacaaaactagaccaattcagtggggactctatcctgctcagattacagaacaattatctgccccatggtctggctgtggactatgagctgtagggaaactgctcttcagaccatcctaggaagcaagcaggggctggagagtgcccagacctccttcgtctgtcctctgtaggatttagccctggatagctcatgagacctggaatgtcccttgctgtgaattccaaatccagccagagcatcacagagtttttcaaggatgcaaccacagatactggtgatggtgagctcttcaggccttccataaacctgggcattacagacatttgccccagcccccaggacttacatgtgtcacagccccattgtaaataagagggtgtttctcacaggatctccagaccagcagcatggatggatgccctgtctcctgtgtcaatgatgccaacgcataagcagcgcttcccttggggagactccttgcttctctcattgctgcttcagaggctgggggatgtggtayaaaaagtgctaaacttagagttggagcctcttcaacaaatctggcctctgcaactctatgtgactgcagtcaattcacaaagatgactcagccccaacaggctcagctgtaaaaaggacatgataataaggttagctaccttataagagctgggcaaacattgagtaacagaacagtaattaatgtgtgttgtcagaactataaaayattcttttaaaatgtttgctgtctttcccataaagtggacacttkcttactgtctattccaacagtgtagactggggagcggggaggtgggcagcagctccaactaatgccgcaaatctacctccaggtgttcatcaggcacctatgctgtgtttagcacagaaaacgtgtaggatcgggttgcttctctccagaattaccatgaattaggaagaaaaaaaaatgcaacacttaggaagagagaattcagagaaatctttatggagaatggaacaggaacactgggcctcacagggaggtcaggagagaaagggaaagacactgcaagtatttggtatcatctttttggtaaatcaggatcctgtagccttgaaggcatagttttttcattgtgtattagttatttctcagaggcatccttgtattcttgttagagactgactgttacatttaaagatgtgggaggtgttggcagtgttcgtggagggtcgcgccctccccacccagagtgaagcttgttctgggcactggcttcagcagctaagcgggtacagcatctctgcatccccttctcgactttgaggaagtatttgtcaaggagacttatgtttcacaagcacctactcagtgccaggctgcacggggctcctcccaagggcccatgacatcaatgtggttattggcattttaccgaggaggcaagtgacggcttagagagtagctcgatagtgtcacacagccaggatgtgaaccctttggaaataaatgaagaccayacaaaggacaacacacacctccaggagattttatttagggggtatgctttggtttctacaggtgtctccatggaagccatcctgaaactctttggagaatactttcaattctgaagatgtctggctatgacaggatgctacggacactgggaggaaatctcatggagtttattgaaaacctggatgccctccacagttacctggcactctcttatcaggtaaggccacttgagtctggtcttggctgcccaagaggaagcaaatgctgtggcagtcctgggccagctccccgcctcccccaacagaggcacggttgcaggagaaccctcccatctgcagaatccttggtacctggtgttggtgggctcaggagttctttttggaagagaatgaaaaagaaacacctgctggccacttttataaactggctcacaaaaaccgaagggatggccttttcagatagggtgtggtgttgatttggaattaaatcctggagactcattacaattggaacaaaggctggaaaacagtcaggtttcagtgcatttgcaaaagctctcctaaggtttcctggccaggatggagctgataaattgcatatgcagccagattcatgttattcatgtatcagaagggaagacttgacagggctaagagccagaatcggaaaccatccaactctgattaacccatgggtgactgactgaggtgttaggaaactaatttccctactgggatatatccttctggagttctttccttgggtttcttgtttgtagagatcactggaaattcaaatgcctagattctcttttattttttagacaagaaaaggtgaaagagcatttatacatatcataataatagtttattgctttagagaacatagtttaattttaaggccttatatatttcaccgagatcttccttcaccatttctatattggtgttcatatccaccctttcagggttgtcatggggacaaaatgggattgtggatgttaaaaagcctcagcaacccttacacccccccatagacgataaatgggaaaagtattattttctccatttttcatataaggaatcagaggcttggaagccttaactgacttcaattatgaatcatgaatagttgggcatgaatagctgggcctgtcctattgttatcatgtgaactactcaagggtagagggagtggaaacagccctgcttatggggtcagatgggcccatgagactgtcccactggctctaccacttaacagctgtgcgatcctggacaagttagttgccgtctctgaatctcaatttattttatttaataatatttattgggtaactaatatttattgagtgatactatgtatcaagtactttttaaggtattggacacaaacagagacaaaaaggaataaatagggaaaagataacttacctcatagcaatatgtggattacaagagataagatggaaaagtctagcattgcaatcagcccagaaaaatcagctttccataaataaataataactctattccttcccctttcttttctctctgttcaatatggccagtttaagaattaacgataatttgcatgacaacttcctttcaatttcttagctaaagcacaacaattaggatataaagaaatagagttaggcccttttaatatttttttataacacatatattttttatcctatgatctttttcctttgcttttttataatttcaattttttaaaaaagattcagagggtacatatgcaggttttttacatgggtctattgcatgatgctgaggtttggggtatgattgacgctaacacccaggtagtgagcatagtacccaatagtttttcaaccctcgaccctatcccttcctccctcctctagtagttcccggtgtctgttgttgccatctttatgtctatgtgtattcaatatttagctctcacttataagtgatgctagagaagcaatagaatagaacttatctggtggtatttgaggacattttgcacataatgaggtaaataaaatatttaaatattataatatacaagttggaagaaaatacatgcaatgatacctaacagctatatagtgctttattctgggcaaagtattatagattgtctctttaggcaaaaataacaamgtaagataatgttcactttttttgtgtctatctagtaatttggcagtgcctttaaggtatacatttctggttataactgagcctttaatcttgttatgctttggccaaacttcattgagtgctaattatgaggcaggtgttgggctaagtaatgtgtcaacattgacktaccttcttgatgccataagagtaggcagtcttatttttcctgttatacggatgagaaaactgaggtccrgaaagttcaagtaactgtccccaaatcacccaggcatggtggctgagctggacccaaacccacacctgtctccaaagatcctgccctgtgctgttctcattattctttggaayaataagaactttgtcaaagatcacgtggctttaggtgtacagccttatttctgggctttctattctgttctgtaatgatacctaacrgctatatagtgctttattctgggcaaagtattatagattgtctctttaggcaaaagcattttttttattctgttattctttgccctaattctccacttttaaaaagccctatttgaagcaagaaataaaagtgtaattatattatttagagacttagtgacattgaccagaagaactaaaagcatgaacttttggaagtgtctctgggcagggggtaaggagtgaggggcatgaagcaggatcacgtggactttctttcaggcctctgtattctgttactttattttcactatgtaggatttggatataatttttaaattaactgttaatttcctattttatttatgctttttatatgtgctgcctcaactactctttacattttgtcaagatgtaaacacacatacatacagataaatatatgtactttctctaggtacatacttttggaattagaaaaaaatagtatttgagggctgggcgtggtggctcatgcctgtaatcttagcacttttggaagccgaggtggacaagatcatttatgcccgggagtttgagaccagcctgggcaacacagcaaagccacatttccacaaacaatacaaaaaaaaaaaagtagctgggcatggaggtggcgtgactgtaatcccagctactcagaagcctgaggtgggaagatcatttgagcctaggaggcagaggctgcagtgagccgttaccgtgccactgcattccagcctgggcaacagagcatgactctatctcaaaaaaataaaaataaataaaaaattaaaaaaaataaaaataaaaaagtatttggggaaaaaaaagaaacccattttaactaacaacatttcaccatggaagacgacaaagatcttggaaggaacccatctcctttacctattccctcacttggaccaaaagctgtgtgtccagggtgctgagttgccctctaactagctagagactcccctaggcaaaatctctatccttctttcctagtatacatctcatttactgtgaaatgataggtacttgaatgtcaacatttctggagaaaggggaggatctcttctgatgtatccttgaaggttctacttttttttttttttttgagatcgctctgtcgcccagtctggagtgcagtggcgccatctcggcttatggcaacatcggcctcctgggttcaagcgattctcctgcctcagcctcccaagtagctgggactacaggcatgtgccactatgcccggctaattttttcgtatttttagtagagacggggtttcaccgtgttagccaggatggtctctatcttctgacctcgtgatccgcccgcctcgcctcccagagtgctgggattacaggcacgagccaccacgcccggtggaaggttctactttctaaatgttcaaattgatatcacagaagacattatcctttcagaacaagacattgattaattctacttgcaaattctctgattccctgatgtgttggaaagtgaagatgcccatggtcacttggtcacaggccaagcgcggcggaaactcactaaggcttcctgttaccagcagacagctgcttttggaatatgggtagaaacagcatggcacggtgcaaaggctcatttgggaatcaaatgttgttctaccattaacctaggtttgccttccctgagcctcagtttcttcctcttcaaatggaactagtacttgccatatagagttgtttaaagtacagtaggtatagtataaaattcctgacatacaggagcagaaacagtgggagtttctatgtgattggagagagggttggcatatagctctgtatgatgtaatgggtaaatactattgtttcacaaagcgtcaaaagcataatttacacaatttgtgtccactgggaaaaatgtgtgtcttttaattaggagatgaatgcaccatcgtttcgtgtggagagaggagcagatgggaaaatgtttctccattrctactcggatagaagtggtctgtgccacattgtaccrggtatggaaatggcttagctggccgcagagctatggggcttctgaagtgaggaaggtttccccatagattctccaggatggctaataactggctaygggtaagaagttaaaactcttagaatgtgtgacttcatatcatcttgaccactgctcccaatgtccttgagcttttaaaataagtttccaaaattccacaaaaatgagtaatttgtacttttctttcaacattttaaatcatacaggcttttacatagttgtgataattctgcgtatattattttgtatcagctttttatttgcatttagcattgtagaaaaagcatgtttccacataatctttaaaaccacatattaaatggccgaatgatattccatattgtaattatcttaactaatcccctattattaaattttccattgatactaatcgtttgcttttgtaaacagtgctatcatgaacatcttcatacatgctttccatttatatatttttttcttttttttttttgagatggagtctcgctctattgcccaggctgcagtacagtggcgcgatcttggctcactgcaagctctgcctcccgggttcatgccattctcctgcctcagcctcccaagtagctgggactacaggtgcccaccaccacaccttactaattttttgtatttttagtagagacagggtttcactgtgttagccaggatcgtctcgatctcctgaccttgtgatctgcctgcctcagcctcccaaagtgctgggattacaggcatgagccaccgtgcctggctctttccctatattttgtatataaccctgggatagattcccaggggaacacttttttgaacttgatccttaatgcttttacaactgaattttgcttacattatctctaggtttatttgtttgtttaatgagttaaatgcctacctgaaataacaaacaaatgaatagatgccaaactagaaattaaagtggcatggatatatttggtatccaaacatgtataacttcagtctctgcatatttttatttaattggctgtcactgatgtctgatttgaagcagggcctgggcttggtgaacttcagaatattcatcagragttttgccatttgattattttatgatttttgctgataaagttsccttcggccatccctcgacaataggtgtccttctgctgcaggtatcattgaggctgtggccaaagacttctttgatattgatgtaatcatggacattcttgacatgaatgaagaagtggagaggacagggaagaaggagcatgttgtgtttctgattgtacagaaggctcacaggaagatgagaaagacaaagcyaaaaaggttacaagacagtcagggcatsgagagagaccaagaggtactgggtttgctgtgcctttagaaagaacagttgcacttaagtagagctacgagtcttggaaaaatctatgcaaacaacagaatcaactggacctttttgtttttgtttttgttttttacgttttcctttaagttctgggttacatgttttgaatgtgtaggtgtgttacataggtatgcatgtgtcatggtggtttgctgtacctatcaactaggttttaagccccacatgcattaggtatttgtcctaatgctctccctctccttgccccctgccccctgacaggccccggcgtgtgattctcctctccctgtgtccatgtgttctcactgttcacctcccacttacgagtgtctgcggctataccaccctgaacgtgactgatctcggaagttaagcagggttggtcctggttagtgcttggatgggagaccaactggaccttctaatagtggaattaaggcagagtttctcagttttggcactgctgacattttgaaccagataattctttggtgttgatggggtgtctttcacgtcatagtgtgcttagcagcagccctggtcttttcctactagtagaacctcatcccctcatttgtggcmaaacaaaaaagaaagaaaaagaaatgtctcctggcattgccaagtgtctgcgtagtgggggtaatggataaaatcattcccagttgagaattgctgggttaaggttaagtggatatatrctgggaagcattctgggatgcacctgagcctggacaatttttcacctataacaataaccatatgaaggrtttgaaatttgaatttgatggcttttttttttcaatcctcctcaaataaattgatctttccagtcttcagtgcccacttctgcagctggaaccagtcataggtcctgagtcaactcaagactctgtacttggccaccccagttgcaactgatagggtgatcattacctgcttaagttaccatgtatgttagctgaacagctctccatgcacatagcttgtgaaaatacccagattaggattagtctctgattccttagagtattttcaaagtccatctcagagtctgttcactgcagaatcttcaaccacaggaagaaatgttcgtgcatgattttcttgccagatatcatcctagttccctcttgagattttctaaaaagttattgctttctttgatagagaaacagcatgaggactaatttgattaaaaaataccgggaacgctaaagtcttggtagaagtgatcttgtaagccctcatgctgttcctctggccatggatacagttccttatttaaaggtggaccccatcacagcaaatggggtttgtgcttctccagtcatgtgaccaggtacctgtctccctgccacctgcaggccctccaggcagctttcctcaagatgaaggagaaatatttgaatgtctctgcttgtcctgtgaaaaaatcccactgggatgttgtgagaagcatagtcatgtttggaaaaggtaagtgagtgattctcccaagctcagctctgagatcagaaagattgcttgattctcaggagtagtggccagtgtacactgacagggccaagccctctgtgattgtgttggcactagtttctgcaaagcttggatttggtgaccatggtttttaactttaaaatgtcaggctctaattgtccttccattgcctctcawtatttgtgccgggtgacatggagacatcatctcccctgtcctaagaaaaagtttttggagacacaattggaatcactcccaacaggtgatgggtggagagaaggaagatgagcactgatgtgccatcaggaacaatgaattttccacagctcgtcttctgcagtcaggccttctccatttggacacatttctggactggagatctgtggataacaaccctagtcgcccaagcaaaggacactagatcaagagccaagaaagcaagtttctggctctgtgcctaaggagctgtgtgaccctggacaagagtctccatcttctcatttgcaaaatgcaggcattaggcttgctaaggtacccctgtgggcactgagcccgtctaacgattagcacctaacgcctgagtctgaataagggctctgatccattgggagaagggagttagggtgctctgcgtcacgactcaatgggccaggtgacacgcatctgggagaaggtctgcagggctcaaagggctgcattttgcgtccttcaagccatggcaagtgagtcaaacacgcaattgacatcctttgtctaggagattttcatatcaaaaaggctccatttcgaatctctaccccctgccaaataggactgttggttaaattttcacgtgccacccaaaactgtcagtctaaaaagctccatggcaaatgtccctgatgctgggcccggagcacacgctctgctctgctagctcattgtctggctgtcaccatttcaatgccgactctgtgttcatggcgagacatactcaattggcccagaaactcttcagcggcaggcagaaacttggcagggggcaggagggcttctcaacctggtagcaagttttctgtttgttttaatttggaagaagaattgctgtggccatctggagatgctgagggagtccatgcaaaagaagtgagattgcactttgcttgtgaaacacttaagatactatccctatcccgagctctgctctgtgcaagggtggaggcgggagctgcttctcatcagcacttcctttttctatgtccagggcatctcatgaacacctttgagccaatttatcctgagagactctggattgaagagaagacattctgcaacgcttttcctttccacattgtattcgatgaatcagtaagagactcttccctctgtagcttagaattggggctaagccagggaartgagcatgatttacagtccttcatgaacagtggagattttcaagtccctgagaaattcccagggcttgggagactaggctttatcctggcaggaccattgatttgcttttcatattgtggtatcctccagaatccattatgcaggatcttcttgatagggtagaaagggaggtttgaactagtgaatgcatgggaaagtttaccattagaaaaaaggggaaaaggaagtgacactaaaattcactacataaagagacagcagaacacagtcagtagcaacaatagggtggaattctacccatgaactcttcccatccttgtgaccaccatgtatgtctccatcccacccagcttcacattctgcctcttgaacatggggaaggggtcatgccaactcaagccactgctctgtaagagttgtgagcataactatttaagtttgattgttaatccatttctatggwtaaaatatatgtcaactgaattgattaggaactcatttaaaggacacctattttacttcttccttctgtgtgttcactggagatagcagtgaaaggtattccccyacccccttgatggatttcttcacccaggcctgggtgatagatccaatgctatagaatttgctagtttcttcattagtaaatgatagagagagtgagagagagagttgtctcagagagcaaggaggaactattagcccaacagagagctgtaacctcatttctctttagtcggaaataagcctctgagcactctcgtattattcttttctctttcagacattagcacagatttgattgtttcaaaaaaatttattacttccatgatgttgattccattactgaccccctttcccgatagtgagccacagaacatggctagaatgttatttccaaggggaagtttatgggaagggaggttgctttctattcctcagcttatatctgtcctctgtggatagctacaggtgaagcaagccagagtgaacattcagaagtacgtaccaggactccaaacccagaatattcaactggatgagtatttctccatcattcatcctcaagttaccttcaacattttcagcatccgcagatttatcaacagtcaatttgtcctgaagacacgaagagaaatgatgcctgtagcatggcaaagtcggactacactcaaacttcaaggtaatcactcactcctttcctgttgctccccacctgtttgagagattgatccgaaagggaagaggcagttttccaatttcctaaaaagtagggtaggggctacgttgagaacacgttttcttttttctgacgtttccacttgacttgatctgtaaagaatatattttatttcctcaaccatctctggcttagacrtaaactatgtatgtaatatagttacatacataattatacaagtatatacattatgtaattataaaattctgatatgttaccaaaattttcagaatgcatgaggtgctattggtattaaattaatgtctgtattttatgtagcaacatgatcatctaactcactattagtagggcccacattttgtttttaattgtagtaaaatttacataacaaaatttaccattttaataatttttaaatgtacagttcattggtattaagcacattcacacgttgtatgttgtaccttcactaccatccatttccagaacttttttatattgtgcaaaactgaaactctgcctattaaacaataattcatttgtccttcctcaattccccagtaaccagcattctaccttctgttcctatgaatttgacaagtctagatacctcatataagtggaataatacagtacctgtccttttgtgactggcctatttcgattagcataatgtctttaaagttcatccatattgtagcatgtgtcagaatttcctgcctttttaaggctgaataatattccactgtatgaatatacaacattttctgtatccattcacccatcaatggacagttggatttcttccaccactttgctattgtgaataatactgctacaaatgtgggtgtacaaatctctttgagtccctgccatcatttatttggaatatatatccagaagtggcattgctggattatatggtaattctatttttaatttattaaaattaggaacttccatactgattttcatagtggctgctctatgttacattcccatcatggacatcaatggacaagtgttccaatttctccaccatcctcatgaacacttattatctgctttttaaaaaatagtagccatcttaatgggtgtgaagtggtatctcattgtggttttgatttgtatttctctaatgattagtgatattgagcatcttttcatgtggttaatggccatttctacttattcttcagaaaaatgtctattcaagtcttctgtccatttttaattgagttgtttgcttttgcagttgagttgtaggaatttcttgtacattctgaatattaacctcttatcagatatataatctgcaaatatattctgtatgttaccttttcactgttggttgtgtcctttcatgcacaaaagattttaattttgatgaaatccaatttatctattttcttttttgttgccagtgattttggtgccatatccaagaaattgttgccaaatctgatgttgtgaaacttttcttctatgttttcttttaagagtttatgttttagctcttacatttaggtctttgattccttttgagcaaatttttgcatatgccttgaaagggcacacattctgagctatctttctattagagggatgtttagttattccagggataagcacaggcagaactcgggggatgtccaaggggagaatgacatgttctgggaacccgagtgaggtgtagagtggagtgatgggagaggaggctggcaagatgaggacttgaactctatcatgcagctggaaacatgctgaagtgtctgccatgatcagatttgatgtttagaatgatcactctggaggtgtgtgaaggatgggtcacagtgtagagaaaatggatcctgggaggccagacagaggctgcttctggagtccaggaaagaaactctaaagtgctaaactctggcagtggcactggagtggcaattggaggatagactcacaagataattaaggcaggacttggtgactggatgtggggggtggaagagaatcgttaggataattattagcttccttgattgggtaactgggtgatgaaggtgcaattaactgaaaaaaagacataatgtaatgtccttgaggcagggatttttgccagtttgagtcactgctgtatcctcaatgcttaaaacagtgtgcctagctcatygyagggactaactacatatgtaatgaaagaactaatagaaagagaagatttgtggaggggatcgaagttgagttcagtgcagatatccatgaacagatacctaatagggagaacagaagaaaaaaaaacactgttcctggaggtattaattgtcagaatcatcctagagtgtattttggcaatacgtatcaaaagccttaaaaatgaggatattctttgtctaagtaacccgtgtctaagaatatatctttttaacaaactaactagccatgattatacacaaagactgcctcaagcttattcatcacaatgttgtttatacaatgataagctagataaaatataatcaatactagcttattatttaataaaagwatgagcaaggtaaccagcaaaaattaagatgaatatctatatttaatactatgaaagaatatgttatatattttaagtgaaaaattcagattatgaaaagaagatgccatgtaatccctgtttttttgtaaaacaaagatatactacaaaatattaacagtaattatccatgtggtatgattatgggtgatttttactattttctttcactttttttgttttctgcaatgaatgtgtactgcttttacaataacataacaaacatatctatttttaaagaaatacacatattgagttcaggaagcaaggtttctctggaaattcagatgcagtcagcrtggtgtaggatgcagttgtgtgatgctaaatgagaataccaagacaaaaccctcaggaacactaacatttaaggaatgagattaaaataatgtaagtaaaaattcaaagaattaggggacatctcagagagaaagcagtgtcagagaagtcctaggaagtgagatttcgggaagaagggtctggttaacatcatcaaacagcagaaaggctgagtaaagaaaaggccaaggaacttgtgttggcatcggtagcatggaggccattgatagatgggagccacttcaatgtaggcaatggacacagctgctagggacagaggggagatragtaaggtctcacagaccttgggtaaaagagaaagagcgtgactgtgcagtaactagaagcacacagtgtgggagatgattggttgtccagcgagctcgtctcagtccctactggtgacatactctactgttgcatttctctccatgatggcaaggccagatgatytggatggagtccatgtggtgcatggtgtacctgygctytccgaagctccgcagcctgcaagagctggaagaactcaatatgcatctttctgacatcgccccccacgacaccaccagggatctcatcctcctgaaccagcagcggctggctgagatagagctgtccaaccagctggaaaggaagaaggaggagctacaggtcctctccaagcacttggccattgaaaagaagaaaacagagaccttactttatgccatgctgcccaaacacgtggccaaccagctgagggagggcaaaaaggtggctgcaggtaaggcamcctctcctccacagcgtcctctgagcagagcgtggtatgtcttagtggtcagggccacaggctttgaagccagacagaagtggttttgaattctggctctgtcacttgtaagtggcatgatcttggggtaattactccacctgcatattctcagctttgttctctctacattaataataataataataaaaataatacaggagtgaaacatgaattatataaaaatggttgtcaactacacacacattaaattctctaagaatttaaggatatgtcctgagactggcctcattactcagtgacaatgagtagggttcttaactwtaactagaaataatacactcgcacactagttaaatcatagggttcctctgaggaccattctgggacagtatactatttatggaggcagggatgctgtgtttaccctgaactcactttccgtttgtcatgggattgtgttcattcaccagacacgcctggtgaacttactctgtgccagggtgctgttccagatctggggacacagaggagtttacagcctcatgagtttgatagatatatgcagaataaattaatgggggtggaaatgaccaaaggaaaagaaactaatttgcattaaggagcaattattgtgccaggatccatgttagacattttacatgtgcagtttcrttaaattttctcaacatttctatgaaggaggtgttgtccataccatattgctgagcaaattgacattcagcgcagctgataaatgaaagaggtggaaactaactgcgttaaggccatctaactccaaaatccatactctttccatcacacaaggtgctatggcaacatggggacagggaaattaataataaatagatgtcaggagataagagataggggggtgggttggagttgtggaggtacctctcaaaagtgtgtgacacttgagttgggccttgaggctgaatttcagcaagcaaagaggaaaaaggcatttttggagaatgggctagtaagagtcaaagttaaggcaatgtgcaaacgaataccatggggcatgttcccagagcgtggggtatgtggaaaagtggggtctggtgacgctgagtgggtagggtggggttcaggtgatgcagtgatgaatttggactattagggaaaaggaaattgtcttttgtaggcagtgagaattcattgaagtttcttctcttattatggaagtgacaggatgagttttataaatccgattttggctgcagtgtaatgaatgcatgagggggtgctgaaagaccataagggcgcagctgattgatggtagaggcctgaattagggcagcctgaggaagaatcagcaggatttcctcactgaccagatggggaaggtaagacagcggaggcaggcatgggtctgaggcttctcgcatggaaaaatgggatgctttatcctaagacagggccagaaagaagagcagggttgggggagaatgataaggtccattttagaaccattgagctggagatgtctgtgggatactccacacagcatgatcagtggtaggaatcttagtgagagctcataggaacattgtggcatggagctatacatctgggagttattgcaatgtgggcggggttaatcatagactctgaatggtggataagatcacctagaggacaggaagtgagaagagagtggagtattactctttagggaacatctagtgcttaagaaggttgagaagccaaggaaagatataaaacaaggagatcagaaaggtaggaggaatatgaagagaggatgataggccagaagccaaggagaagggaaagttccacaaaggggaaattaccatcagaggcttaactaacaaagaaggcacccggctgcattcaaggagtcattgattcactcactcaatatttattgagcatttactatgtgccaggccctgctttaggtgcttgggatatggcagagatctaaactgacagtctcccgtctcatggagctttgtattccaatggggtggtagacaataaccaaataaaccattccatacaaaatatcaggccgggcatggtggcttacgcctgtaataccagcactttgggaggctgggtgggcagattgcctctgctcaggagttcgagaccagcctggacaacacggtgaaaccctgtctctactaaaactacaaaaaattagccaggcatggcggcgtgtgcctgtagtcccagctactcgggaggctgaggcaggagaaatgcttgaacccaagaggtggaggttgcagtgagccgagatcatgccactgcactctagcctgggtgacagagtgagactctatctcaaaaaaaaaaaaaaaaaaawatatatatatatatatgtatatacatataatgtcaaatgtatggagtgggtggaaggcaatcaagctaaaaggatagccagtctaggggctattttatacagggtggtcaggagagttctcactgagttggttacatttgaaatgtgagtaacaggccctgtagatatttgagaaaagtgtcaggcagaggaaacacctctttttttaagtgtagaagcctgaaggcaggaggcacttggcatgctggagaaaccccatgaggccagtgtggccagagtggagggagccggagggacatggggtcagagaggtggcagggacagaggtggggggtcccctctgtaggccatggtcaggactttgggttgcattctaagtgtgatggaagtcatgaaagatttgagattgaagaatgggagatctgacttaaacagggcatctggctgctatgtggaagttagcatgaatgggggccaaggtggaatcaggggcatgatttaggagcaagtgttcaggacaaggtaggtttcctgccattcaaagacagggacccatcacttcacagtgaccagtctctgtcagccctgtccccaggtctcctgtagctcaggctctgcttggcccacttgctaggggccctttctgtcctcccacagcactggtcacattttactggaaggatttgttcacttttatgtctccttcattagactgggggctccttgggggcgagggcctggtctgcttgccccctgtgatatgattctcctactacgactagcttgcagcgggcactcagtaaacgtgtgctgggtgatgctgaatggggaatggcatccagctacttttcccacaaggcacagggcaggtttgattctcacagggcctcttaatccagaattcatggacttattagtcgatctccttgtttctcactgatacctggtttctgttgtaggagaatttaaaagctgcacgattcttttcagcgatgtagtgacatttactaacatctgtactgcctgtgaacctatacaaatagtgaacgtgctgaattccatgtactccaagtktgacagattaaccagtgtgcacgcagtctataaagtaagtgtctgtgcagtgtggggtgtttcacggtgtgctcacgcagggcgagtgcttgattctaagtctccctttgcctctgtctgcactggtctggggtttggtgtggatgagtgtggggtcagaataaaagctgaaagggaattggaagtattttaggaattctagtttttagaaattctttttacaatgctcagtgctaagatggcactctggtgcccttgaggggcacctagatgtcaggtgttttcatagagtgtagttctcctactcctaaattcagcagaaaatcgaatctaaacaatgtgttatctcatatatagcatcacatgactaccccaggagcttcgtcttttctgggatttgtttccaccaaaagcagaaaggccttttggctctctcatggttgtttcctgagtccttttctttctcacctcctccctcatgctcctcatacccttagcaaagaatcaattaccagctttagtatagtccctttgtctatatatggaaaatgaaaaaaagtgtagtgacatgtttagtgcatgaaggaatccctctgaatacctatttttttttccctgacaggtagaaacaataggagatgcttatatggtgrtaggaggtgtaccagtgcctattggaaaccatgctcaaagagtggctaattttgccttggggatgagaatttctgcaaaggaagtgacgaatcctgttactggagaacccatccaggtagagagcaactgagtacttggcttaatgccaaacatctcacacacaaaagtagaattctgcttatgtgcttaggtgattactgggtaagttgctgtcattaaaatgggtaatgtatcctagcccttttcttctcttgcatrtgtccctaatagagatattcctaaggctcctatagtctcaacttttctcaaatttcagaggaggctgcggtgctcaaggttttcctacgattgactgcaagcttcctttgttggtaattcaggacagtgctgagcagttcttcctatttacctagcagggctcaatccatcttaaacaccagctcatttataattcctgcttttatgttcaagcatttcaacaagtggttcaggtttaatgagcagccaacttttcctgcttaggaaattgtgtctccaacatgccatctgacaggttcagaactcaggctgaggtgtgargctgcctgcagtcagcaggccaggcaccgtgatgccgtaagatattcagaatggctttccttccaccaagtggccactagcgagacatctgctcgcctttctcacagaaaagtacgcttccaagtctggaagtttgttcacactctaaaagttgaacagttttggagrtgaaaaatgaatgtcctcctccgctggctcagcagatcctaatgctcctgggatggctgagagtggcgtctctctgcctttgatttctaggtccttcctctgctaatatcagtcagaaatttaaaataaactagtcaattcaaaataaacaaagccaattataagatggaatatgatttttccacattataactttttacaggagattctgaaaatctgctgcactcactctgaccatggtgagttagaagctgagaaacagtgcagatcatggctacagcatccactgtagtcttctaagtaaaagctggccttagatagtcacaagaacaagatagctgccataatgactcattgtaaacacagtgtgcatcagtggaataaaaatccaatgtaataaataaaaaatcaggatgagaggcaatgagggaagagatataagaaggttagataagagataaatgtttcagttaaaggatgcttgtgtaagtcactggtgaaaaataaaaataaaaatggaaagcatagtgtgcgtgtgtgtgtgtgtgcgtgtgtgtgtgtgtgcatgtgtgtatgaaaggggyatagcgccagagatgaaaataatgctacaccaataagaatgaaattagacaatgaattgttggaaactctcaaggtggatttaccaagaaaaaaataggaaaggatgttagcaattccaaggtaagactatggacataattaggagcatcattaaatatccaccagaaacagcatatcatatgggtttattcaaggatgtaggggagagaactggaaacactttctctcttaacagaattgtgcaattattttgcactgagatattctattattttattcatatagctttaatatacatttactgagatccatccatgtatgagacagtattactaggtgctttgaagggttcagagaatcctgttttcctagagaaattataattttatttcaagcagaagaaaatctagcaagtaaaaacaacaagcaatctgattaggatgtagaaagctgtaagagactgttgttcccatgctagcagttttttttcccccaccagaaagcaaaggaatcaaaataaactaaattccaggaagtgacaaacctttcaaagagaagacacccataattgcattcaatcctggcagggcagcagaagaagtaatccaccagaggtgagggtagggataatcccgtctaaattttagtggacttttaatggtcacagggctgaaacaacaggttagaatgccaaagagtcccagccacagagtctgtacccatctaccaactcttcctcataggccaagtgcaggggattagtcagccaaaaactaggacaggagaggagagctgagagaactcccgagtccctgaggtgtttggggcctttcccaaatgcaaagcagtggcccattaaaggctaatgttagagtaagagaactgagagaaatccaactgaagtactcttcgtcttcaccaagtacactacgatgaccttttgaagtatgagggcaaggaggaatggcagagaaaattttcccaaggtgcagagagccagggtgggactgaagagcaaagagacttctgaaaatctcactgttgggctgtaatgcaggaggagatctcctacaactccaaaagctgtggattggctrtacagcattcaaggtcctcagagtcttgctggtgctcagattctaagctctgctgtactgaaagttctgattcagccttcataatatttgaaaccagtggtgcatggaatctaccaatatttctggaaaagccctgacccaactcaaatatggattagatttacttactgcccattccagcagcctaattctgtagggatgtaacattttctggtggataaatattatctacttcagtctctactgtattttcacacacaatatgggtcattcaattagataatgaaaaatatgagatgcaagaagcaacaagaaaatagtaatatagtggatagccaatagagaaaatagtcaatagaagcaggtccagaaatagcctagatgttggatctttaaaattagtgtgataaatattttaaagggtctataagaaaaggggcaaaacaagtgtgaagatatgggaaatacgtacatactgtctatatttacatctatatctatatctaacagaaaactatgatatcagaaatcagaaataaagaattaattttatgggctcaacraagactagacacaatagagaaaaaaatcagggaatttgaagacagagaaatagaaatcacccaaactgaaatgcaaagaagaaaacagggttaaaaaggggaacaagacactctatatctgtaggacaatatcaaatggactcccatatatgtaactgaaatgctagaatgagaacagagtgagaatgggtaagaagaaatatttgaagagataatagttgagaatttttcaacatgaaggatatcaatgcacacatccagagctcagcaaacccaagcagaataaatacaaagacaaccacttctagttaaagcataccaaaaactctacccagtgaactaaggcaagaagaagaaatataagacattaagtttggaaatgaatgaagaaataaaattatcattattcacagaacaaataatggtgcacctagaaactcttatacaaactacaggaaactacaagatctaataaatgagtttagcaaggtcatagcataaatacaggaaaattaattaaatttttatatgttaaggacaaaaaattgaaaatgaaataaaaagaaaataaacttaattaaatttctaggagtaaatctaacaaaagatacatatgacctctatgcttaaaactataaggtattgcttagggaaattaaagaggacctaattaaatagagagatataccgtattctttggaaaactcaatatatttaagctgtccattttccccaaattgatgtatagattccgtagaataccaatcaaaatccctgcaagcttcttagaaaatattcacaagctgattttaaaatttatatggaaatgtaaagaatctagactaacccgaacactcttagaaaataacaaaattggaggatgtacacarctaattttaagacttattctaaagcaacagtaaaaaaaaaacagagtgagattgggagaagaatagacaaagagaccactggagcagcacagagtgtccagacatagactccatgtttagtccattgatttttgaccaaggcaccaaataattgagtggggaaggcaacctctttttaaaaaatgattctgttaccattgaatatcatgtggaaagaaaaaatgtacctcagttctaccttaccccatatacaaaaaaaatcatttgatatatatcacaaatcgaaacataaaatctagaatcacaaagcttcttgatggaaataaagaatagcatcatgactttggggaaaacaatgatttttttttttttagataggacacaaaaaacactgaccatgaagggaaaaaaatgataaacttcattgttacaggctgaattgtgtcttgcccaaaattcttattttgaaactctagtactcactacctcagaacatgactgtctttggagctagaggctttactgagtaaaatgaaaccttaagagtaagccctcatccaacgtgcctgatgtccttataaaaatatgaaatttggacgtaaagagacactaagaatgcatgtgcacagaggaaggaccacgtgaggacacagcaaaaaggtggacatctacaagccaagcagagaggcctcaggagaaaccaaccctgcccacagcttgatcttggccttccaggctccagaattgtgagaaataatttccattgtttaagctacacagcctgtggtattttgctatggcagcctaagcagatgaatacattcatcaaaattaaaacattctgcttattaaagaaaataaatacacaaacccacagactgataaaaatatttgtaatacatacatattacatatccaaatatgtgtacaattcatacacattaacaataaaagacaaacagctcaatttttaaaacaggcaaaaaattgaacagacttttttacaaaagaaaatatatgaatggccaatgtgtgtgtgacagtgtgcctaacatcattagtcaccaatttaacgcaaattaaaaccacagtgagatatcatttcacacccacgagaagaccaaatgatggtgaaaatgggaacaactgaaagtgtcacrtcgctgatagaaatgtaaaacagtaaaacaactttggagaattgctgggtagttttttggcttgttttgttaaaaaataaaattaaatctgtatctaccttgggactcagaaattccacttctaggtatttacttaagagaaaggaaaacatgtctacaaaaatatctgtacaggaatgtttatagcagccttaattttaatagattcaaactgaaaaataatctaaatgttcatgaaaaggagactggataatgaatgtggtgtattctaacaatagaatgctattcagtgataaaaataactactgatatgtaagacaatatagatgaatctcaaaaacattatgttgagtaaatgaaaccagatataaaacagtatatactataagattgtacatatgtgatgttctggaacaggcaaatcattctttggtaaaagaaataaaaaaggccaggcgcagtggctcatgcctattatcccagcactttgggaggctgaggcaggtggatcgcctgagttccggagttcgagaccagcttggccagctggccaacatggtgaaaccctgtctctaataaaaatacaaaaattagtcgggtgtggtggcgggggggcacctgtaatctcagctactctggaggctgaggcaggagaatcgcttgaacccaggaggcggaggttgcagtgagctgagatcacactgcactccagcctgggcaacaagagtgaaactccatctcmaaaaaaaaaaaaaaaaaaaaaagaagaaatgagaatgtagttatctctgctgaagaagatggggagagagcttaactagaaggggcacaagataattttgcaaggtaatggaactagtttacattttattttgggtggtggttacagggatataagcacttgtcaaaactcatggagccaaacactttaatatctttttttattttatgtaaattatatctcaacttacaaataaaatcaagagtattagatggtctcttttcagtgatgctgtctctgtacagctcagagtggggatccatactggaccagtcttagcagatgttgtaggagacaagatgccacggtactgcttgtttggtgacactgtgaacacagcttctaggatggaaagtcatgggcttcccaacaaagtgcacctcagtcccacagcctacaggtagccttccatttattcatgccttcctttgtcccttcctctttctagaacttacagagtgcctagcagccatgggttggggtagtgcaggaaactcatgtttttccttccatgtctcaatggcttacagaagatattgtggcagataataaatttagttgagcttctaactgtagcatagtttttactgtcaaggagcatatagtttagttcagggaacagcaaagtataaccccacagaccaaatctagtctgctgctcatttttgtaaataaagttttattggaacacagccatgcactttcatttacatatagtctatggctgatgtcatgctacaaaggcagagttgaatcwctgcaacaaagaccatatgatacacaaagtctaaaatatttactatctggtctttatttatataaaaagcgtgctgacctttggtctagcagaagaaaaaagaaaagttgtagttgattatttttaaagtgagataagtacaatgacaaatatgtgcataaaacaatacttatagtttcttgagcacttaaaataggccacattctattctaaattcttttatatgttaattcatttacagttgcaacagctctgtgaagatacattattattattatttacatgaaagaaaaggcacaaaaaggttaatcatttgcctcaggaccaggtaggctaggaaggagaatagcccagatgcagcccacggagtcagagttcagtgtcccccctttaactgctgcactcttatcctcaaggtagtcaccgggggtgtcatgagagcccagggcaagggtgcttgacccagtaaaaaagggcttcatggaggagattcctgagctgaatcttgagcaaggagttccagagtaaaatttagccaaaattggggtattgggagtaaaaagtgggtagaggctcacatgtagaataggtgcagagaactataaacacccgaggttttctgtattggaaaatatgaggcaggagcagtgagagctgcacatgccttactgaagggcaagagccctatgccgtaggtgaggaaaagcccccaacgaatgtgaggttgaagacagtgacagggtcagggtcctatttgacactgaccactctagagaccctgaaagggcatatttgagaaccagaaaatgagacagatgagacctgttaggagtttggtctgaatcagaacattagtggtgggaatatgggggaaaataaaaccagctaaagtagttagaaatgggggatgagaagaaggggggagcccgggtctccattctgggtgactagggcttgaatggtggcctggccatctgcaatgggacaaatgagaagtatcccagatcataggggcagacaatgagtttaggttggacacgctgggttcaaaggaactgtggaacattcagctagaggtgccataaaatggatggagttgagttattgaagatccagacttggagtaagcaacatataggtggtaataacagtcatgagagttgatgagatcaacccagggaaggatgcagtgtgcaaagaacagtgggaaaagaatggaatcctgtgcagaaccaatatttaagtggcacagaaggaagaggagcccagggaagagacaggagaagaaatactcagaaaggaccaggagagttgagggtgagaagcactcttgtggatgactttaggaaggaagaattgaacaaaaatgtcaaatgtagtaataaggactgaaaaatactcactagaggttttggggacattctcaaaagtggttgtagtagaatggtgggatagacgttgggctgaagaataaaaagaggagaaagtttgcatgagattaaagcaggtgagaggctrttttgtttgyttctgtttaggatggaagagacataagcacactgaaaagcagaaggagaaaggcaaatggaatgggagatgaagataagcgtggggtggccaatggagcaaggcccagaggtggtgggaagggggtgagggtgaggagaccctggacaagaaatatacctcatcctcggagattgggggacaggatggtgtggtcatggggtgagaagtcacaggctctcacctgtaatcaatgtaattttgtagatgaatcagggcataargtaggaggcacagccaccagcgtatgagtgaggggagcagatgccaaatggaggcccatgaggactgtggtgaaggtctgaactctctaccaacctggccaagggcaagggaaggctcgatggagtgccgaggcaggtggtcatgaatttgaatcctcattggtctgagtggttctttggcttttctctaacatcacttggtggctagtaaataaataaacagggaaacgttttgtaattaccccatagctctgtctcttttcatggtcccttccctatagtcctcctcttcagttccttggcagacagaaattgtggtggagaaagcttgggtagttaggatgagcatagtagcaagcatggggtatatggtgcacttggggaagatggaaagaagagtgttgatacccaagagtcttacgtggcagaaacatgaaaggtggtgtccacatgggcactgacagcatggtgtgtagaaacgtgagagatgcccatatgagggttgagctggagggaggaaaattggtggcagggttgggagggttttgatgggtccctgtgttctcttttggcctttggcatcctgttcagaatatctcatcctcactttccccacggcctctgtcctgcttcagcaggcagatgtctgggatcttccctcccctgctgttgtgtgtcctgtgtcctggacttttcctcttgagtagccctttgcattgtagccaactcttgagttacagacccacaatctttgatatctgatgcactttttttctctgtgcagagccttgaaaaatcaagggtttaaaatcattgagaggggtgaaattgaagtgaaaggtaaagggagaatgaccacatactttttgatccagaacttgaatgccacagaggatgagatcatggggagrtctaaaaccccagttgatcacaagggtaagcaaaaaagagaagctttgtcattagtgttgagtagtttttccactaaccacttcagatatgtttattatttgcaggktcaacacagaaagcatccttgcccaccaccaagctccagggctcagttcaaccatcttgccctgaacactcttctcttgcatcctggttattatgacgttctttgagctgggccratagatccagctgaagagttctacatacattagtcttcaaggttcttctctgggcrtttcccatgcagctctctggtagctggggaatgatttgtgagtgcttcctctgctccacagcctcagaggctccagcacaggcttccctcgcgtgctggaacctttttcacattttgttctagcttccaaaactgggatgagggacaaaatttgtgactcacccagctccaggaatgacaagagggtgggagtttagggtaaaaaaacccagtactaagctggaccagggattactgtttggctcatggtacccccaaaaagaagctggaatccaatggcgagctctccatcagctgcaaggctgatcagtcccacacactcagggtcccttagccacagcctggctaagacagaagtgctgacctgaaggggaaacctggtaataggaggcaagcctttctgaacctccaagaagggaatgaattccttctgacaggagctaatctttagccactccagaggcccacaaggggaatctcaaagtccagaggttccttatttacacagctattacacgcagtatgtctctttgggacatgtggattatgatgactatttttaaaagtrgggctatcccaaagaaaagatggattatttgaagaatttttaaaattgttgtcataatgctttcattctaatatcagctcactgtagtatccctgtgagctatagttggtttaggccacattttactgttgtagacactgagatacaaatatctaaataaaaaacaagaaataactttggtaataaggacsaggagcagtcctcattagaggttttagccccagaatttccaggctctgggcacctcatccactgctatctcccactccctcccacccaccatcatgccagccccacagtacagagggtttctagagagaaggcaaacaaacatcccccccttttctcttcttcgttgtcaagaaatgaacaaagtaaagtggggagggggcatcatatcacgtgatcattggagaggggaaggcagggctggaggctttggcacaggacagggcagatgggtctcagctgtgcctggctgtaaccccacactgctctctcccactcgttcrctgagggttcccacacttcttagagaaacagtattccggagcaaggtctgagtcagtagaatcaaacccactttcagttctgagctagggaaaagcaaccctgagtagaaagtgaggaagggtgcctcaactgggagccctcagaatggagcctgagaaagaggagggagggtaggtgtgaaaggagggcaggggatagcagcccccatcccccgaggccccagtcagtgtctctgtgcaaattaagaacaaggacccctttgtgggctatggggtcgacagcccccagacatggcttatcatagaggaaaatggcaacctctgtgtggactgaggtcagtcctcaccctgaaccccttggccaggtgcctccatgtagagaaaactgcacaaacatatatgtggtcccaggaaggaaggatcccaacccttttcatgcttctgtgcatttcccagtcccctctccctttccccagcagccttggatttcctgctgtgagcctcagccaccaggctctgggggagggtgagtctgtctctccctgcctgccttcatctgcagcatgggggctctagcaggaaggccaggaactctcaggggagacctcatgcagatactgcttcctaaggaaccccattaacttccggggtccagggtgttttctcccagtgaccactgacatctccatgaggcaagatagagcctctcaaagacagtgatgggggaggggcatggaaacactgttatgttcactgatactcttttcacatgggtctattccctcagattatctcccatgggacacacacgacttttttgggggggttacttagggaggagcagcagcgagggcacttcagtgattctagtgtgcagtcagcattaagaactatgtctaagaccaaagcaatgcagaagaaagggccctgcagggtctttcttgtgccccactccaccctagcacaaaaagacccagaaggtgacagaaacaagaaaggatagtgtccaggagagctcttcctcaaatgagcctcctctcctccacttcgttctcaagacagtgcatttcctcgttctaggtaatgagtacatgaaacacgttaaatgtccttcagcctccctaccacgacatccaacagctggaacttccatccagtccttcacatgatgggcacctgtgggaaacctgccaggggcagccgatgttcagaggcatccaaaaaaagtctcccacttcggcagccatgaagcccactcatgcaaccgtcctcacttttccttcctctcacggttttttgcagaagcaagtgctcagggaaatgaagacaggagaactgctgccgtcatgagctatgccgacagtcagcagctgatccccgacagaracgcagcagatgcagacggtgagtgcagcaggcctggtctaaaatacttccagccttgcattgctcataaagacaatcggacacttcagaggtcacttcayaggcagtgagaaagagccgggaagggatagcacaggtggagtttggtgtcccggggcaggacgctactgacttgcttgctgtattttgaataaactgttgttttgagcacccctatcccaggtgtcccaagggctctcattccggcagggccatctatactcgcttccaaaagaatctctaataccagaaaaacgtattactttctgtgcatccacaaaacaaagtttctctggacagcgtggccctcagtagcttgccttgtcttgctaaggagagctgagacttcctcttcctgcactatctggtgctttacagagacctcagggcattgacacttccgcagagtagcccagttactctcttctccactttgtcctgagggtcgtagggacaggagggtttgcttaattcatgcttattctggacggccttggcagtcattcagctccctcagagccagagccattctcaggactgacaaggcttggtttttgagtatggagtcacaaaggaataatgaagaaccagggatgggtggacaacatgaacccctgtagcagcagctcccccatctttttctagaaccctcatgctaggtgatccrtgtggagttaaaagcggcacggccacagtatagaggggatcacatctcatgcattttctaaaaaccatctctggtcactgagacaatttcttaagacaaatgaaatgatccatgtgatgagttagaacagcttaataatccatataaaaagtctagctctcgttatctttattagacaatatctctaaagttgagtgttgcttgagcccttggcattggcactgccctgaygcccaaaggcttccctctagcttgatcctagaacctgaggttgagggaatgaatagcagcctcctgttcatttcaggtgagaggagacagagcaaaacttctctcactctgatcctggggtcagatggacatttgcattctgggacatgagaagctcaaagcaaagtttttgccattgcctggaggcatttccctcccgtccccactcctctccttcctggagttgcatgtttctggcagtgcccaaaaccctgaatagttgtccaacgtattacaggatagaattataacactcataggtccatttgatagtgttccttggaaaactgttgctgctgcaggaatggacaaagcrtctagtcactgtcctgggatctgcaatgctcactgaactaaacacwtgagattcctgcctttgggcagcttgtggtttagtagagggaaacagacaattaacatgtaactaaacaaataagatcattggggtagtgatgaatgttaagaaaaaaataaaactcagtagagggccagtgaagtcttctgagagggagcagcatttcagctgagacttggatgaaggaagaamccccatgtggctacctgggtaggggcttccaggcagcgctgtgcccaaggcagaaacagccttggcaagttcacaggagacaagaagaccagtgtgcctggaaagggctgcaagaggaagggagacatagggatgaaatcagacaggtgtgtcggggcctgggacagtcttggccttgagactgcttatcaacgtgcaaaaaagcatgagcatgaaataaggggtaggtgaggaggcgctggggctcccggagaccttcagagggagaacggctctgccatttgaattcctaaatggcggttccataaacagttcagaagggaaggtctaaaaaactctttatgctccaggaagatgagtaaattaatttttcaaacttctgctgcgtgggagatggggaggtcctgccacagggaccagcagggctggatgtcttgcttagaggtgagagatagaaatttcacagcacctcttctaactgtggctttcctggacaaaaagcaacactgaactagagaaggaaaaattgaggccacctcagttttggggggaaactckagcggtgaactggcatttttttggcaactactttgtgccaggcattttacccacattatcttatttacacaacagttatataaggtcccacaactagtaagtggaagaaatagcatttgatcttcatttcagacttgtttgtctagggcagatcaygtccgtgtgagttcattttgagcatcagaccaagacaattccatagtttccctaagtggtggccactgcacttgaactgcttgggttgacaatggcccagccatttgtctctcagatcctctgggccccatctgaacagatctctgattgttcggtgtgattagcaggtgtattaatgaggaagcactcccacactgtgggttcatgacagactggtgtgcaccaggagtgccactggacccaaagctacccacaccgagacgtactgaaccagaaactgccctttcacaatgtgccccagtaatttgagtttgggtttaccactgacatgggcttcttcctcatctttgacagttggcagcagacatagaatttagcagtggaggactcatgccacctgctcatgggagctgcctcttcactgtggttcgggtcccggttctcatgggttttcaggtctagctaggtctcctatatcatgcttagctctgaagtcagtgaaggctgccagagggtcactgtgggagcccccagcctcgtcactacccctgggccatcctgcccggcccctatgtgggcatcgcgatggggaagtgtctgcatcagtagccatgacctgtcaggactcctcagagaccaacctgcttctcaggctccaggcagctgggtggacgttcaagacttgcttcrttcatcatctctgccaccaatctcaccaggtggtcacctggctgccaaacatgatggctcttcagtgscacaccattccatctgacttggccctcttgggtgggaaacgggcactcctggccccctctccccggagaggaccgtggatcctgacaaagtatctcagagtcttggtagcctgtgcagctgcagcgcacctagacttctctctgctggccagctgaggcctggggctcacgcgtatctcgaccctctttaaaaagggggccacagggagtccctgcaaggcccaaccaccttctgccagggcagtagggagcgctcagcgggacccaggcctgcaggctgcatggaggacctcatttgcacttcaataacatgcttttctttcacttaactatatatcttggtgttagatttgtcagtggagagactcccyagtgcaattaaacgggagtattgagccggagagaaatcagtgtgtgttgactcagatatttaagcaaccacctttcagtattgactcagaaattggccttccagctgtccctgctggcagactcttctggcatctcgtcaggccgctgttaatgtgtttttcaaatttcaacttgcttcaacttgtctcctaactgatcctcctgttgatgacaataatggtttccaggctgacctgcacacagcacttaggcaagcagcccaggcccctctctggaggcgaccccttccttataaatcacagtcagagggcgtctgcttgctgggttcatggcaggttaagtcagcttgggggacttctcaagcaactcctaattgttcctctggagaacttgagtggtgagggtctctctcctgatgaggttagactttagcggtctgctgctggaggggttgggttgctgattccctccaaatttcactcactcttccaaacaggaagaacttttccaccatttgcagtctccctgatgagtaattattggatgggtttgtggtcacttaattaccagggcccttgccccttgctttacagagtcgtgactatacgagcacctttcccagacgtggccaattagggggggcccagctggtttggagccaggcttctaaggaaggctgggtccctgttctcagctccgagccctttctgcagcctctctcagtccttcctaagtgtggctgtcaaactttgctgacctttcycccttggggctaatgagtgtcacagctatttttaaccttgggttttctagaagttgagcygttaacctakctcctacagaaggaggatcctgggaggtataaatgaactcttcacacacaaggaggtgactaatggaggaacataggattttcagtgtcagggctagccttgaagttttgtgttgacacccttgatagcatcgaccagatgtcaaatcagagctggtcagcacaggcggcatgggtgggagggcagccagaccatctgtggaacaacctgttsatagtatagacggctgagcctcacctgagagggatttggcaagtctgcagtagggctgtgactggttcgttaaccaactttataggggattctgatgagccaactggcttggggatcaccatcgtgatggaaagggcaatagactgaaatcagaattccaggtcctggcagtcagcgacctgtgtgttacttcgggcaagtcctcttcaagacatttttctcatcctgaaggcaggggtaatggcgggccttcttcacagggttgctttgagaaatagatgagatrgtatgtagcacctgaaaacagcagagtgtcaggtgtgcggactgctgagtcacttgggcattcattcgcttaacaaatatatgggtcttaacacaaaactgtaagaggtactgcagaggtttktttttttttttttaaatatgatctgttgtgtgcgaagagcttcagacaaatgggacagaggaatccacatgggaagtcaggctcccagccttgtgcagggcgctccagcatgacagtgtgcacaagtgatgctgaaacacacactgggatttggaaaacctcttagacaaggtgcatgcaacagcagaaacaagaatagscaaggatctgctctggtctctggaaaatgtggggacttctggaagctgggaatttatttcctgcacggcatggcctcttttgttcatggatggaaagaggcaaccaggcagtgtgatcctagaacagccaccccttccctcatcctggaaatgccactgcactctttgtatcgctagggtagaagtatacactcactggtagaatttcccctaaaatttcatttttggaatttgtgtctcttttgtctgttcacacatcccctgctcttcctctaggatgagggtgaacgctgggaaaactgagatggaagcaagtgggagcggtacagggctctgcacaagtggagaccacacagagcaaaggccagtccagggtggggagagaggtgggacggtggcacaggccctgtgctgtcaaggaccaggatggggtgaagcggtgaatggggtgaagcggtgaatggggtgaagccgtggtggtgcagggccctggagaagactgagtgcctgatttcaggctcaggccaaaccctccaccccagtcgtggagaatcagtgttgaaaccaagatgtggtcttccatatcttattctgtttagaaggttagaaacagatgcagaaatgctatgaagtgattatcttaatggcaawtgtaagaatccttcttgtaaccccatatcatatcgtgtatgactcatagagcctgcctgtgataacaggtgatgatccacatcccacctctattccccaaggcaacagcatttcctcacattccatgctgctatcgctgcagccactaccacccccaactccccarcctccaagtttgtgtttgacaatctcacatgataggtgttttccaaatgggaagatttcttctgcaaccattcttttcatttaatctgttcttgatctacattgagatagatttctgtgctgattttaatactgagctatgtgatttttccaattaaagactatttgtttatttgtattatagaagaaatatttaatttttaataagtatggataaaccaaaagaagaaaaccaaagcacctataattacatcattcagagagactactattaaaatatgggtcatatcttccctgacttttatatgggaggctgtgtatatgtgtatacagacatgctttttcttacaaaaatggaattgtcatgtatatactgttttgtaatctggcagggcatgaatttctttcctttgaacatttaaacacttaataatactgaggaggataattttaaaaagatataatgtgcttcacatggtacccttatttcccatgtgacttgtgctattacatacccccaaaccacttttacattgtaccaaatgaaaatcccaattatcttatactacccacatctacaacacactttggtacccttgatgttccatgagtcctgaagtttcctctaaattttccaagaaagactaaacttgttcaagttagctttggtgcttagagtatcccaggtgtctagatgtcagcaacacatggaagatgtaccttgtaatttctattaattggaaaatgtaattaaccagaaggctacatttcccaactgtgcacaacaatgagcattaactgtaacaaaatgatggtactcataggcagtccttgggggttgtgaacaatggttttgtgggagcgaaagatgatggacgagaatccatctcaagtaaacaaaattcttccagcatctggattgtggaactgaattggagtagaatgtcaaacatatatgtgtgaaaattccaagacagccttgcagttctgcgctgaccaagtcttgtttgaattgtcagaggcrtcaacccaaattgatggagtcaggtttggcttgtccaactttcactgtgctgtttcagttcattttctcagcacagtcctagctgattgtcctttctgtctgttctctgttcactctttagggagagaaaagggaaagaagaaaatgaatttaaaggaaataggagtagaagtggaggagatggaagatccagttaagatacaagtgagagaaatgaaaaatggtcaggctagaagagagaaaaatgtgctatgaggcaggagagatgaatcaacgctgaaaagctacatttctgagaagagaaattgcaaggggaaaaaattagagtgttgaataaagaggagacgaagatatctgtaaaatattgtttcctagtgttgagcttacttccaaaataccttatgagaggttaggccagaaaatagattattccttttggttacaaagaaatcatggtgctctcaggaagcaagagcagatcatgaacacagcctgacagctgctgggtacagggaatggtttcctttaccgtatttctgctcattttagcaattccagccctttccagctcagttttcattttcactagagtgacctccacttttcatacaattacaaacatacaaaacaaataagttctgggatcacaacacttttgtggatatttttttctctcaaagattcttataacatttctttgagttgagggggagacagatgtgttgtgtggtgttgttttacatctggagaaactggggcacagaggagtattgggggagagttcagctgctctttgtagtgctgttgggtggtgatggatgtggaggcagatgaccaggtcttctcaacagaaaaaaattacacttccatctgtaatcaactcattttttctctatttgctatgatgacaaaacaaaacggaacccaaatttcacaaatacactatttttatcatttaacctgcatgtttccatttttgaaaaatttagttctaattataatagtttttacatctcaaaaaatacaatactgcaataaactccataattcaaaatgaaagagagtattgggaataataaaattagtagagaatcagcaaaaagcaaaaacaaaacaycctgtatctgaataagtaacagtttccaaagagcataaaatactgctgaatataattcagtcgtgtgtgtgtgcgtgtgtgtgtgtgtgtgkatgtgtgtgtcagagagagagaatatgtaatagcaatcaaatgaacatatagctaatgatatctgtacttagctaactctggttgcgccataccctataaaatgtcacagttgagagtttcatgaaccttgattccttttcagattggccccaatatatgcatgagctaaacgcttcctgtaaatcattgctggaagttgcctcagtgacatggccctacatgtcccaggaatccccctttctctgctccagggccctctctccaattttcacctcattctgggcctgagactgagatgagactggggagaggtctggtagccccaaattttccacatgtatgtcatcactgacattcctcaatgagcagtgcattagcgaatggagcctgtttctgtctcattgtttgtgctcttaggatcttaaaacaaaaccgatcactaatccaggttcaggatgaagtctgagtgctaacagcctctaatagtggaaaaaaaaaagtcatccattattttgggaagagaaggccgaagacaggagcccctcttgatttcccgctttctataatactagatgtacgtgagcctcagacctaatacatgcgcctttctgaacttgaatatctctgggacaatgatttatatttttaaaaaaggaaatggcaatgatatatgactttaaaatctcagacgctgcccttccaaatgaaactgcagggaacgcgggaggagatagattcagtgtcctccacccggcctctatcccattccttctctgatcccactctctctcttgccttggctcacagtcccggaggcggtttttctccagggccttctcccagggctccctcccatgcttagaaatactaattggcatctttgagtttgtgctctatggggcattgcgtgactcacttggtataaatcatctagtttaatgatcataacaaccctggarggcaggtgttatttctccatttttcatatgaggaaaactgaggcccagagagcttcagtaactcatccagggttacaggtcaagtagtggcaatgctggctctgaccttcagcctccgtgtctgctgctcagaagtcacagacagccacaggccagaagacaaggagacttggtgctattgtgtgagttatgcagaagcaaagatgtgggtatgaccaaaaagatggcacagggcagttcaaagaactcatatagccacaaggcagtggtctgtccgggctgtttggccttggctgtgaagaattcttcctgtccaggatcacacygagtagaaaaggaggcccgtagtgtccacacgtgttccccagggtctggcccagacagacagtctgaggctcgatcacttgctcacccctctgtgttctttcagctcctgatgaaatcatccctgtggggagtgcagggccagatggggactccatggagacagccgaccggcgacagccttcagctccgacaaagacacatcaccttgcaaatgacactttgccgtctggtttctgtgttttgttgtaacaggttaaatgaacccctgggcttaattttccccctacttagttctgtggcagcaaagaaaagtgacttcttttcatttctcagctcaaaacttcttaagccgtgtctcttcctcatcatccctttgagaataaaagtctagaaatgaaacacaatcctgacaagtttggaaaatgtgcttttatattcttagttcaaagccaaccctaaactttgagattttgggtcaaatttgttctcagagacgtaagttcggccttgaggcctatttctgtcttcttctaacaggaatgaatggcttcaagctctcatcactatggttccactgaacctttgcctgaacaagagccccagtggctgacaccctgactctggaggctcaccttgttttaaagggtggtgggaaggagaaagggaggaggaggggaaggcggagggggagggggaggggggggaggaggaggaggaaaaggaggaggaaagagacccaggctctgcagtttataaatcaccccagaacacagccgggctgtgaaaggcactcagccagaagttgtgaaagcaaataattttcattccctgccctgggaattacgtgaagcaacagaacaaaagctgcattccccagagattttctgaacgtaaaatgaaagggaaaacatgaaaatcaccggaaaggcagagttaggaaagctaaggaaagaaggcagagcacagccaagacacctttggccggttcgtctcctgcttccagctgtaggtgcagaataccttctgcaaagaagagtgttggaaatgttctcagaggccatcccaactaggagaagcgaggcatgagatggggctatgcatctgcatttcgtgatgataagaaaataagtattttttttgacctagacattaacgaaaatcttaagggcacacaggagcttgtgatccatttaagctagtaccttacttgtcccaagaggcattaactgtctcagcaattcccaggagggcacaggcaggacctggctctgtcttcagccaatcccagggcctggagacaaagggaaagtgacaagggttgaattccttgctgcaatctttctagacagcaactgtgtttggtgtctagaaatggacaggtgtgacctgcagtccagcgggaaacagcaagctcagattagacaaagtgcagagtcaagagatgggggttcttgcccaagctttaccacctgatacaccagctataaaatggggttagtgacagctgccccacctacctcatagttttatgtgtgcatgtgtgcgtgtgagaattcagtgaaatctaagagcacaaagataatgacaatgcttacagtagtaataaccacagatgctcctccacttacgatgagggttctgtccagataaacccattgtaagctgaaaatacaaaaatgcatcaggtttatatcctgataaaatgtttatatcctgataaacccatggtaaagttgaaactgtaaatcaaactagcttaactcagatgctccttgacacacgacaggattacttcccaacaaacccactgtagagttgaaaaactgttaaatcaaaccatcaggggaccatctgtactaacatttatggagcctcaaacatgtgccgggcactggccctgcatgcatgtatgttacacattacttctgctcctgacagcaaccctataagaccactattccagtccttacttgacagacaaggaaatgggaactcagggagacttagtagcccaagatggcaccactggtgagcagccaaaatagggagcctaaagctcagttattacaccatcaaaagaggtgggaaagcctggtggtatggacccgggactagctgtgcaactttggcaaagttgcttaacatctctgggacttggcatcctatttgtaaaataagggtaatcagagaacctgctgcatagggttgtcatgaagattacctgagatgtccacaaaacgcttagaggcagggccgacactttggtaagtgctccttaaatgctagcattttaaaattttcttaaatgctcctattgagtgactgatctccctgcttaagtggaggcaaggaacgatgttggagctcacgctcttgttactttagtgatacggtttcctttgaaatccttagctctgctgtgagtgagaatcccatacagaacgaggaaccctgttatgtggtagcattgcctgggagataaagagcaaaacagttggtggggtggtggctttctgtttcatttttagaaagaagaaaagccagagcctgtggttttagcccccagctggcagcttgctttgcttccttggccctgatagaatatgccagcttaatgttcatttgtaccgacaactgccaggaattgtgaagcaggtgccctcatcctgggctgaaaatgaagagaattttgctcaatatttattaggagtaaaataatagtttccagctttaaaggaatgactacatctccccgcatttggtgtcaccctggaaactatttattcttttgagtaaacactgctggagacaagcttcaggtgcccaagcaacctagccaggctgatgaagtgctctgtgagcccccagcactcactcgcacgggcaccttcattctctcttagtctgcttctctgggttggaggcctcaggagccctggtaccaagctgggtgtgtgaacactcactaagagggcagattcacttgaaggaggcctgcacctctgcacacatctgcaagtgctaggctctaacaccagcctctggtggtctgtctgatgtccaccaacccccacgtgtggctgtcactccagacaacagacttgtttacaagcagtgaatgctttgctcagcagagcaggcagaatgaccccagaccaagcccctctcagcctcagaatcttcaaggataggagccctcccacacctacaacctgtcagtttcatttgactgcccccttactccagctgcctccatctcaggcacctgttcaggagcatggcagaccaggatcccagcagatggctggtcctgcaggctgaggactgacagactcattcgcctgtggcccacagagacaggcagacattgtcattaggaagaattgaaaacattgttcactgcccctttccagtggggcacagaacttaatcccatggcctctacagcagcctgcgcccctcctctcagcctctccacatcaagccttccaggcaacattggatcgtggaggtgaagttcacggatgtgtgtggaggagacaacaatgtgtcgggtgtcccctctgtctccctgtcttctccttcgtggacatctggagacagttcttggacgctcagggctggccaaggcctggagtctcactcttcctctgggctacgaggacctgcttgttctttacaatcacccgttctcccccgccctttctttttcaccctttctytcttttccaactccccttcagctcgagttgtgtgtgagagaaagaaggcggctcacgtgcccggctgaggaatgagatcatttctctccccgtgtagcgggcttgctgtctgctggtcagggttactgggagaaagcaggccagctcgctctccacagagagccatctggctccaacagactcacgcggatgctaatctattggtttctttttcttttattctttcattctttctttttgtttgctcccaaggaacacttcatctgcagctgtaaattcagacctggccccgtgaaggcgagcgttcattcatgcacttatttattcctgcattatgccccctcgccccctctcctctggtaggtgtcaggaagccattgttatcattggtgggtctatgtcattttaatgtcagggctgtactttcaaatggaaatcaggcaattacgctccacatggagaaatctgacagatgcagaggttttacaccactggccgtgtggcagggacaaaggcgaccagggctcccaggggacggttaaataaatagaatatgtttcaagagtgcagaaaaattcaagaataattaactgcctgatgagagttcatagatcctgtggctgtttatcttcagaatgtgataatgatatgtcaacgaaccacttaactcatccttgtaaaggcagcgttagaaaactgattacaatgtgcatttacacagaggcagactgctctgtgcatctgttttccggtttctaaatgcaaagctttgcagtattttaacttgctctgtttccccctcgcaggggttctggttggagaaagatggaggcatgttccaagtctgatgtctacctgatgaagcactgtcatgtctacattcactgttagctaaccacagtggtatctacagataccagtggtgtgtaatatcagtgttatctaatatcagtggtatccacctgggaactcaaactgaaaaacatggtaactatatcattgtggctattgttggttgatgcttgttttgcatcaagcacccagctaattattctccataggtggcctcttatagtcccgtgagtgtgacgtatatagtattattatccttgtttcacagaggggaaactgaggcttggggctaagtggaagaagtggccttcagacctagctctgcctaactctgaccttagctctcagccactgggccccggtcctctccaatgttccagcaggaagaaaggtaactactcactcacaccctgtataaagcactctcatcatgacagacacatatagttggtgtgaactaaacaggagagatctaataaaagttaaaacttgatttttttccctgacatatccagctgtttaaacagacagttcatttggagcctgaaaaagggtcattattcaatgtgtccaaagctgggtttacattagtttattttataaaaaagtaaagtgcctccaactactggtcattgctctcttctattgtggaggagtcagggagcaggcgagggtgtgtttggacttcagcgccccctgcgcttcctcactaagcagctgccttgaaatacacggaagctgatgccaattagaacacagaaaaaagggaggacgttttatccctcaggaaaagtatgttttaaaccaaacaaatgataaaataaatacaacagatttatgtactaatctccaatgctttctccgatgaatgagtgccatcctgaaagtccatgaggcccctctgtagtgagcaaacatgaatcaaagccagaggtatcaggagacaaaacatctactaatttgctagggactaataaacatcagtcacacccacaacaccctccattataacttgttttaccttgtccaagggtaaagacataagtaaggagactcacaaccttttagagcattagctttgtcttaggtgaggaaaaaaaaataaacatgcttatggaggaattagttttcttttttcatctctattgaacacattggtttgaaagcattagcataataaacttgcgttacaaaaacaaaaagtactattaaagtatcctttccaataaacaccttaattaaaaggattcaaatactagggaaaagcacgaaagagacaaagtcatagctcactcaagaacggatcactcgagagctcaagaaaacaacaggaacatcaagccatgggagggctgatgcaaggtctgggatagtcagaatgaacaactcttgttccacagagaccaaacactaaagaatgaagggaatcaaaacagagagaagaaaacgggaaaaccaattcaaggccagcattaaaaaatctgaagaggatgggcgcggtggctcacgcctgtaatcccagcactttgggaggccgaggcgggcagatcacctgaagttgggagtttgagaccagcctgaccaacatggagaaaccccgtctctactaaaaatacaaaaaattagccgggcgtggtggcacatgcctgtaatcccagctacccgggagtctgaggcaggagaatcgcttgaaccctggaggtgsaggttgcggtgagccgagatcgcatcattgcactccagcctgggtgacgagcaaaacttcgtcacacacacacacacaaaaaatctcaagaacaaaaatcgaggtcaacggccctcaaaata

SEQ ID NO: 17725 - DNA, 176930 bp, Homo sapiens
tatatatatatatattttttttttttttttttttcccctggagtctcacacaggctggagtgcaggggtgcgatcttggctcactgcaacctccacctcccaggttcaagtgattcttttgcctcagcctcctgagtagctgggactacaggcgtgcgccaccacgcctggctaatttttgtatttttagtagagatggggtttcactatgttggtcaggctggtcttgaactcctgacctcgtgatctgcccacctcagcctcccaaagtgctgggattacaggcgtgagccactgcatcccgccacattttctaatattaagccatctttacatttatggtatcaacccaatatgtttattatgcatattgtgaaaacacattgaaattggtttaataatactatatgtagaatttatcattttttattccttattagattggtctagtattttcttttctatggctttgtcaggttttggtatcaaaattttattagcttataatggactggggtgctttttttctttttctatgctttgcaaccatttgaatagaggttatttgtccatgaagatttggtaagtcttaccaaccaaaactttgaacttttttgcatatttatttagaaataagaatttaaattatttaatggttttaaatacatttgtattatttttgaattaatgcaattttacaatttattaaaaagtatttcagctctgtaattttgctgtttttcaagttttaaaaatactgagctttgtattatttaaaaattttgcacataaagtaaaattttcttgatgtgtttatcatacatttaaatgtactttggccaggtgccgtggctcatgcctgtaatcccagcattttgggaggccgaggtgggcagatcacctgagatcgggagttcgagaccagcctgaccaacatggagaaaccccgtttctactaaaaatacaaaattagctgggcatggtagcgcacgcctgtaatgccagctactcgggaggctgaggcaggagaatcacttgaacccaggaggtggaggttgtggtgagccaagattgtgccattgcagcctggacaacaagagtgaaactccgtcttaaataaatgtacttcaattaaaatcatacaaaatgtaactgtactgttttgctaaattacattacagagagtttgcatgagtttacacctatttttcaagtatcattatttaaaagaaatctttgtcaacaaaggaaaatgtaaaatcatgtattattttaattttcatcttttattgaattaaaaattaatttattgaagaaagtatttcagccaagttttttaatgttcatagtattcttaggatttaaaaaattctactgaaactgtaattataatctccatattcatagccttcttttctcttttttcattgtcaattttaccagaaatttatctatcttgctattgttctatagaactaggtttttgttttgttgaccctttctatgatttctttgtatccagatccatttttagctttatagttgtatatataacacacatatatttttttccttttccttgtctttcttcactctgttttagatctaagccttttttattttggatgagggagactacagagaaaggatctgctagccttgacctacttctgatgttacccagagtattcatgcagatgtatgtgataagaaaaaggtgaacacagagttactctgtttggggctttcattgcagcctagtccttgcaggaggctgctgcatgcaaacccaaattctctccattcttggaatctccttatgccacctgcactctgaagagtgttattattattactttttactaaattgggctgccccacccacctttgccgctggacttttaaaatagaaaggtttcctaaggagaatgcttttttttcccccctagccaaggggaaaaacactggagaggcacaaataccccatttcaaggaggaagaaaactatgcctggaggcatcatctgcaaaactttccggaaaaggctgagttctctcagggtattgtttcaccaaaatactgtctttgaatcagtctctaccttaatagactggagggaaagtttccaacagatcgttttgctgatagttttgattactctcgaacagaaaatttcaaaagctttttgccagagggaagcgaacagagggaggaagagagaactcttccatgagtgtgccatgactggggaaccttttgaacaaataatagtgccaaaggcagtgacagccaatttttccacccgaaatgcttctcaaattatagtccttggatcactagcttatatcaatagtctgacaaagtctatggtgtccttccagatattaatgtaaaacctgaacttgaaatatccatcacaatgtttcattttgctgaactttttctgagacacagtcttgttctgttgcccaggctggagtgcagtggtgcaatcttggctcactgcaacctctctctcccaagttcaagagattcttatgcctcagcctcccaacagctgggactacaggcatgcaccaccatgccggctaatttttatatttttagtagagacagggttttagtagagacagacatgttggccaggctggtctcaaactcttggcctcaagcgatctgcccaccttggcctcccaaggtgctgggattacaggtgtgagccaccatgcctggcttcattttgctgaacatacatatatatttaaaaattttaaaactttttaagagacagggcctggctgttgcccaggctggagtgcagtggcacaatggcagctcactgcagcttcgaactcctgggctcaagcgctcctctagcctcagcctcccaaaatgctgggattacaagcatgagccactgtggctaagaatattttttgtcatgtttgacagcgccagctgtctttgggtctttacctctgctgaagtcatttgaagaaacaaatctaaagaaatactgcttggcagaggggaggagagaaaggttaggacagaaagcatcaggatgactctccaagaaagggaatgtctgaatgacaagaggactacagacaggagaaaacattcaagaaaatttatcaaggtattctttgttcctgttgaaacctcatcatcaatgttagtgtcttcagaagcccacccaaatatattattttactttgataaaagacaacttggaaccatataaaagactgcactggtaccattattccattttacagatgagaaaagtagctcatttggaacataatgagctaggttttatggattaatctagatgctgaactgaattctgtattgtatttcattttctctgtccttttctactggatgtacatacctacatttaattttagagttatcgatctaaagctggctgcagaagctgtctcatttagacaggtccacgcttgtcaggaagacaggtctgtccaggcagacctttcagtttgttctatatttcatttcaggccacagcagaccaaataaagaggaaatgaagtgttttatagcaaataacttactgttgaatacacatgtcttgtacggacaggcctcccaatttgatgttagaaggggccacagagtagttaagatagtcaaaacagaagcaactgtattccttaagaaggtaagagacaaaatcaacatattaaaaatattcaagttgagtggtaggtaagaaactccttttactttacctttgatttatggggaaaggctaaacatggaaataattaattttaaaatgtctttatattagatatagaagtattggtgttaagaaatctgatagtaagtacagtgtataggaagaaagagacgggaaaattagctaataagtgattttttgacttgagtagagctatggttaaaaatatatggaaacctctttcgagtatatttttttcttaccaatatatactttttatgatactgagattttatagtgaacatttgcctattcatcccaatataatatttcttatagtttggtatcaacccctatcattatttgtgagataagggagtggtttgtattcatgggtatacatatctatacacatttctgcatgccgtacacaaacataagtagcattgtgcatgaacatattagcactgtgcatgtactaaaatttcaattttttcacatagtaggttataaaataaatcatatattcgtaggaaaggtatagaaagcaaagttatttaaagtggatttttaaaaaagatttgaatgattttttttaaaaaaaagattagaaccattgtttttaaaaggaaacagctttagatagtaaattatttacagccaggactcagccctgagcatcctgtgaaaaccacacgagcttggtcaaggttctaagcagtcaccggtgggagatggtcatggtcccgtcacagcataactcacttgaggcttgaaaagtttccgtccagctacggtttgcagtgacctttctcttctgcaaagcccacggttacctggtggccaccaccaacatagccccgcctcgctgtcctgcgtttctctcaatcagatcagtcctgccgagtccccatgccttactgctggtgtgctgtgtcctctgtgccatttcaaggcgagggctcatgaaacttttactcacacgctgctatttttgatatgcggtggccttagctgtggagcgagaggccgataattgtgatcactccggaaatcctgggaagccagaagtgggagatgggtgtkgtgaggtggcgtggctagggagaccccatcgagtgggtgtgttataagacctgggcgaatccctgtggctgccactctcctgagaatgttccctaggccttagtcccgcgccgctcccacccacacctccaggtgtgcagtccccgcccttaattactctcactaaaattgatagtttacacttgcaaagctacactgggaaagcggaagagaaatttataatcgtggatatggagaactaggggagcagacacacttgctttggtttacagatccagtgaagtgaaaaatcagaactagaaacgtatgcaccttcctagcagcaaagccgcttctgcgttcttcgcagcctccagtgcagggcggcgctgggagaaactttgcgccttctggaaagtttagaaagtgagccacgaaagagaggccacatttccggggttttgcgggccccgcgatgttttccagagcttttcgagtgggaagaggagagcgacaacgtgaaaatgccccgtgccggggcgtccaccggagtcctgccagctgtccggcgctggggtaagcgcaggaggggcgggggtgggacccgagctggcggccacgggtctcccgctgcgggtgtgtcgactcgggggcggggcgggggaggctgctgagataatgaatgggaggctaaggccaccccccagccccggccctgccaccaccgtgggctgtcgagccaatgaatggaggagggggcgcagaggtcaggggcgctgggggcgccacaccaggtaaggggtccagcttgggagcggggagggcggactctgggggttcgggtgttgctgacttgtgctacgtggaacaagcagaaaagaaggaaggcggaggaagagaggaggctggcgtcggcgctgctcctctggccctccctctgcgccccctcctcctgccagcgcgccaaagccgggcagtaggggccgactggcggctgacgctccctgagtggcgactccgtctccagccccgctgcggagcgcgggccggatctggggcggccagggcccggagccgcggagccctccccgccgcccggccgagcacgggaccccggcggggtgggcgcagggggcggccccgctctgggcgactgccgaggggcgggcggagggccgggctcggctggcggtggggcgggggccgccgggactgggcgcgcggcctgaagccagcccgggggcggcaggagagggacgcgcggcggcagcgagcgcaggtaagggggccggcgcggcgtgtggggacggcgccccctgggcgcgaagccagaggccgcggcgactgctcggcccgccacacggcgcgctgggctcacactgtcccgccgcggacgggctttgtggttgggggcgcgcgtgcgagtgccagtgagagtgtgggtgcgcgctgtgggccgcggcgcgggtgggtggccgtgcgttcttgcgagccggcctgcaggaggcgaggctcccctggcctcccgcacccagcggcggaccgagcccctggagggaagttgccgcagccgcccgggccgccggccctcctgtcccgcgccaggtcagtgcgccccggggcccgcccagtgacacgtaggtggcctccggttacctgggtcggggtgggtgcgcgggagggcttgcgaggggccctcgaaattctcccaaaacctcgtcccgctggacttgcacctccgaggggtccctgcgcccctggggctccgcacctctcgcttcccactgacgactcggttgtcccccaccaccgggctgaggacttttaactaagtttctgtccagccgcctaacaaacgtgcttaacaagtaacaggaggttgtaaggcaagggagggacctggctttgaaagttgatggttttgaaatcgacggctcctttgacttgcgtaggactcctttgtggtgaatggatttaaagtttattcttgtttttctttgctgccatttggtctttgcaatgttaagagtgaaggcattcaggacttgctgctgcctgctgtctggggcctgaggttgtggctctccgcttctgctctcctctcttcatttttgttgaaatccgtggattttttcataaatgtgggtgctggcttgtttcactatggacgcgtcgtttcctatggggttagatagatattggtaaacataaatattgaaaatgtgatgatcacatattgatgatcacagcgaaatcctctattccttcaggctctaacagtttgtttttcacgtatttgcataagtgtgtttgctcagctaagcataattggtaagccagaggtctgtgattcagagtctgcagttctggttaaggggagactgtacacttggaaaatgcgaagttttttaagaagttattcccttgccggatagaagagtgggtcccaaggaaaaagggtgtattttagaggtatggttatttgaaccaaactaaacatcattaaaatacacagggaggtagaatgtcacctagttctttctgcccttgatttccatatcccagtaggagcgagtataattgccccaaatgcaaaattatgaataataatcagcattgtaagtatattaaggttgcatttttttcttgatacttgtctgatttgaggataaaaacaccaagtggcaagagaaggaggtagcttgaggcaggaaggcacgggcgaggagcgaggagggaaggctgggttgtcatcatccgagcccgcaaggtacaccacgtcccctagcggcgcgacctcagccagtcgggtcagctcagatcctggtctccgtctccccatccggaaaatggaaggggttggtgatcgttgctgttccttccagcttcccaaatagcgagaaaccggtgggaggttatcttattgtgttagagcagtaggaaaaggtaggagggggaagtgagaggtccagagggccaggaagatggaagaaaacmagcaacagaggatgcttggaggagaaaaattcttgagctgggagctcatttcctcttttttttttttttttcctttcctcaagggactcaataatacttcccccacctcagatcaatctcttgttacctttattatttaaagcttgtgagtttgcttagctaatgcactagggtgaggtcaaggtgatccttgcagtctgacttctactaggcatcacttgactcatttgcatcattgtctctcaagggaacagctcctgcccaggtctgtgggcactcagcatggatttcagtctccctgtgagtgatgggaaagaactaacagaggtaagaatgtaagtggcagccctttcgaaacttctatttttgttcaaacctaatattttccaaaaagtgatttgatttttttgttgtttcaaattataccgtaggctgcaaggttttactgaatctattccattagtgacctactggaacgttcaaagaataaaaatctcacttgctcagtgtttttgatacacagtgacattcagtctgaagtaagtgatatttagggccaagaatcatttcaaatgcttagtatggaaagttgcaatctgggcagaatacactgtatcattttcactgggaagctccaagtattcagcagataacagaactttcagaatttagtttgaggtcaagattttaatgtctgtgtttgatgtgtggcctgtcttccttttctttgatgttttggtatcaatatgcctacacccttgaggaacattatttattgtaaaagctgaactgtgatgtaataaaaacttaaacataagctcttggtttaaagtccaatagtcttctctggccttaagtcagcatcatactactgtttggtttcttatttttacatatcatgttaccctcttatttaaatatcccgggccaggtgtggtggcttatgcctgtaatctcaacactttgggaggctgaggcaggacgatcgcttgaagccaggagtttgagaccaacctgggcaacatagtgagactctgtctctataaaaaaaatagaaacattagctgggtatggtggcatgtgcgtgtagtctcagctacttgggaggcggaggagggaggatggcttcagcccaggattcaaggctgcagtgagctgtgattgtgccattgcactacagcctgggtgacagagagactctgtctcttaaaaaaaaaatcttagggaaaactattatggatgtcttagaaagttgagagaaaaggaggtaattctatttcagcaaacaattattgaattccttccatgtggtagatgcaaggatggtgaaaaggaagctccagaaagaactgcaacacaggggggaaagatgcagtgagcctcacggttcataccgaatatgtatatgcagtgttgtgtaactgggtggtagctgtagagtccaagaactttggcatgccagggaatggagaattacgttttgattcaggggacgaatttataaatgtggcttgaagaataacatatcttttaaaagatgaatggtgggggaatgaagacaaagtgagagtgtggggtgatgaaggctggaaagttacgaagggacaaattgtgggggacctctgatgttattttaaggagttatgctacatggggatagggaggcaaggaggaagtattacataacctcaagatgtggaaagacactgagtaacacatattggggcagagtgaggggtgcgatgatggayggaggactgggcttttattccattacaatccgtgtaacttatggctgctacgttttaagacactattgcctgtttactcaaattatataaaggttgtagaataaactaataagtagtttcttcctccctactctccgcaaattgatagtgctttatacttttgagaaatttaatttagtaaaaattaatgatgctattgtgttatagctggaccttgtggagccttttgaacatgtggggttgaagtcattctgcaggcacagagctgtccaagaaaacattttttttcccctctcttttttgtttagggaagggcttgctggttaatgctaatttaaacatgactcttctggcagctggcattcttgaccctgtttatgttatacatggtatttaaccacagtgattgggtatttgcagcacagaagaaaaagaattattattagtttgaaaccggcattaatgcctctgtaaatgatagggcaaggcagtagatggaaggagagagggaagccaagtagcacactcggtactgcagtgagagatgacataaccatgagaattctttaagtttaacttccagtagaagtaacttgctttctatatattttaaatccctagagctaaagcatttaactcattatcttcactctgtgggatccatttgggagaggtattcaggagctttataggttcacacttgctccccagtacctstgtgtcacaggaggatatacactggttttcagttgcatgtcagaggtggaactgacttggatgtctttgaattgctgttgaatctggagatgctagggtacccaggagacagacaggaaaaagaagaggctgggcacggcggctcatgcctgtaatcccagcactttgggaggctgaggcgggtggatcacctgaggtcaagagtttgagaccagcctggctaacatggtgaaaccctgtctctactaaaaatacaaaaaattagccaggtgtgatgctgggcgcctgtaatcccagctactcaggaggctgaggcagaagaatcacttgaacccaggagggagaggttgcagtgagccaagattgtgccattgcactccagcctgggcagacagagtgagactccatctcaaaaaacttaagaaaaagaaaaagaaaaagaaggtggctgaatttctttcaattaccttgtgaattcaatttaatgaatgatcttcccagcagtttgttttatcttctgcaagggaacttatgtttggcatgtttaataaattaagttaattaagttggagaagcccaaggttagtatactttattttaggatacatttttggtaggagaggaggaggggtggcatggtggtggtgatgattttatttaaactctttggcattttttagcaggttagtatgatttcaaagtagtgttgttgttgtattatcaacttgtggggctgggccaaagaatattgtcttaatacttgcatgtccctgtcatctaatcagtgctatagaaactttaaccctgaagtccatgtaaaattgtaattatttttttccagaaatgaaagagaactattttactacattcatggatttaggttataatttattttatttttgtgatactgttttaaaaaagtgatataatgacagggcagacccttaactttagtccagtgctaaaacaaacgtgcaataagcctgcatgaggcagggcaagctgtgtttgttgtattatgaaaataaaggaaaatgttttcaaaaccagcatttttctctaaaagaaaaaattttgactaataatacctggccatgggtgggatttccagctgttggttgaaggaaattttgttcattatggccattatgtgtgctatgtctcttagagtttaggatttgctatgctgagattgctactgtgaaccattcctgttatagcaagtttccctatattcattaacttatgtgtctaaacaatgctctagattagactttatatcgatctgttctactaaattttcttcccctatgcctaggtggttctctttgaccaacccttaactgccctgattctgaaattctgctctaattgaaggatattcctgggtctttggarggagaaatggttcaggggcagaggaaactttttttccccccatctcaggagcacttaactgactgcctgctatataccaggctttgtgctagttttactaggggtgagtgtgaataaggcaggattcccaccctccaggaggagcttacacacgattaacagataattacaattcagtgtaacaagtgttatgagagagaagactttgcgggagcaccaagcgggggcacttgaccctcagcggtgaggtggtggaggtcagggaatgctcctggaaggttaggatctggaaggatcctgggagataaaccaagcctagaagaggtaaaaaagggatcaagaggctttctatctccagtttygctactcctgggtaggtcaaagtgcctctctttttacatctggaaaataagaataagaactgatatctggttggtaattctagttttcatttactatgtgttccttaatcctttatattactctttcttccatattcagtaggcatttgtacccaccctgtactgggaagatagcactgcaggaaacaagatgtggacagaccccttctctcatggagcttgccctctatcatatgacattagtaagagaagttcttttagaatgccttcaaactcaggcatatgtatcttgttattcttccattttaggaacattttctccaaggtagtctcaatactttgaggtgagttggcctttcccttttaaggaaggagaccacagagcccggtaatctccttttcattttatatgcttgaaatattttgctaggatttatctgttttaaagtctagagatagacatagctgtgttttatctgtagccctgccttgcttccatctcattttccctattcttacttttaacccaacttgtgtttgagattctttgctcagtatatagtttgctttctagaataattcaaacctagtgcctgtagaaagtcagacttattttttatttatttgagatagggtcttggagtgcagtggcataatcctggctcacggcagctttgacctcctgggctcaagctattctcccactacagccttccaagtagctgggaccgcaggtgtgtgccgctatgcctggctattttttttctttttctttctttcttcttctttctttttcttttctttttttttttctttttttttttttaaagaaatgggctctcactacattacccaggctgttctcaaactcctgggctcaagggatcctctcaccttggcctcccaaagtgttgggatgacagctgtgagccaccgcatctggctaatacttattttgaagtcaccctgtcatggtgctttgcttcactaatgtatttcacttatgatcttgaagtcactcagggatacaaacacaataaaatgcatcccaaccaggagagggtagctgcattcatttacaaaatttttttttgcaatgattcaaacactatagatgtgtctaaagtaaatgtaaaaatctctctctgccactttaaccttacccatctgatatcagtttgttccatagccttccatagttgtccttttacttatacaaacctacaaaaattaatatttatgtatatttatgtgtgtgtgggataagtgtggatatgtttatacatactcatatgtatgtttgtgtgtgtatctgtctgtgcctgcctccattttcttttgctttagagaggctatacttgaggctgccatcaagagtgagaagtttgaagctggaagagcctgcatgggcccttcttgaactggtgcagcatgtgcagcatgacatcactcaagagttcttgtcagagtgataatgaatgtctggctattgtaaacgggaacaagaaaactatttccagctgtgtgacaaccaagacgacaaaaagcattgcagagaatattattgccacaaggaccctgcttcatctgggtctcagacgacgggaggaggggcattttggagcacgtgtttggcatctgtgaaccttttgttaggtagaaaacaaggcctgaatgaaaggcctttcaaccacttctggagcagagaagataggtagagttactcattataggcaggtttcattgtaggagtattcagtgaggacccccgccttggaagtctgtaatcagcatatgataaggatggtgtgttcttactaagagaataacacaactgaaacagaattgccttttgttaaggggatgctttgccttcttggactacgattgtggggagaaggattattgtcaactaagtgaggcattcattctgtacccactatttattgtagttccacagagaactgcttgctttactttctgactaggcacagaaaagtaaaggttcaaaggctagggcaagatgactgacttttccagatttagcacaatctgttctctggtcactttgagacgctgtcartttagtttcatgcagctgatatcttggagaacttctgtgtccttacgtttggctgaggacactaaattttttttttttttttttttttttgaggcagagcctcactttattgcccaggctggagtgcaatggcacgatcttggctcactgcctcctgggttcaagcaattctcttgcctcagccttccaagtagctgggaccacaggcgtgcaccaccatgcctggctaattttttttgtattttttggtagagatggggtttcactgtgttggccaggctggtcttgaactcctggcctcaagtgaaccacccgcctcggcctctcaaagtgctgggtttacaggcccaagccaccgtgcctggcctgaggacactaaaattaaaaaaaaattaagaaagtacggtccccgctcttgagtagctcatgaacatggagcgacatggactcaaatgattaagatcaggtaggtagtgatgaatacggtaaaccaaggttcaaacaaagagctgtctgcatatctgaggatggagagggtaagtcagccttagaggagggaaatgacttgcagcaggatgccagcctcaatggtctgtggagctcattccatgcagaagagtaatgaggaagacccagtgagtgacaggcttggggaggagtgcctgaaattgacggtttgtggcaggaagtggtgggaccaatctcgaagcttgtggaggtagaagggtactggagactactgtggacaaaaaagggcatgttgatgccattaccagacaggacacgagagcatgatgattgttgcagtgaggcttgttagttttagacatgtctaaaaccatgcaggcagagattttcagctggtggctggcaatttgagtttgaagtttagctgagaagtcagttggcagtattcaggcataattgctaaatgtagaagtaaatgccagtaaaatgtgtgtgataagctggagagcacttttagagtgaaaagattgatatattttaacaaggacaaggcttatttcaattctttaggttatttttctttagcagattaaagtagttttatcggttatcaagcatttgttgagcgtttactatggcttctcttgataggtggtcctggggagataggaaggaaatggtgcaaatttcaacaatacccactggggtgaacaaaaaatccctgaaacaccccattccagctattgttatctggaaaaaaatccttacaataattagatggtgatttgacgtctgggggaagttgcagatatagttttaatttactgtaggactagtggcagtgagtctcatattgctgtcatataaaaggtaaaccttccagaagaactttggaaatttcagtagcytaaagaccacgctttgagaaactcgtaaaggtttgtcatagaggttttaaaagtctgatcaaataattttaagctttagttgcctactaaaaagtaggatgcagtacaagtttgtcctttacttggtaaaaaaaaaaaaaagtctttttctaattaagaatttattttcaccttagataattttattggcatgcctttttgcatgcaagatagaaaaaagacaagtttattcttagttttcttttttctaagccattatgattcttttaaattatactcatttcaatttgataggaaaaaacagtatatgctcattttaaaatatgtggaatgtacagggattcatgtgtagttccatcacttaagattgactttcttgctaggcatggtggctcatgctggaaatcccatcactttgggaggccaaggtgggcagatcacttgaggtcaggagttcaagaccagcctggccaacatgataaaaccctgtctctactaaaaatacaaaaattagctggatgtgctctcttgaacccaggaggctaaggttgcagtgagcagagtttgtgccactgcactccagcctgggtgacagagtgagattctgcctcaaaaaaaaaaaaaaaattcttattccattttgggataatttcttgcagttttaaaaatatttgcttttacggaatatttaacagcattctcctttgtatcataagtatgtacacaggccattaaaatctttcatttttaatttctaatgactacatattagtcacactatttaatgtgtgtgtgactgattaaacatacctaattatgtttagtcattccctttctccgcttgcttctttttttttttttttttttttttttgaggacttgtgcttctctgcccatatttcagtgttgatgttcccagagttctatccttactctaaatgatctccatttttgagcttatccacacagtggactgtggtttcctggtctttgtccttctgcctaggacgttctttcctaggtatccacatgcctgctctcattattttcatgtcttaactcaaaggtcaactttgagttaaggctttctatcactacatttaaaattgtgtgacctttcctgtctacccagcttgcctgatattttcttctccattgcacttttcttctgacttcttagatgaggacaggacttaaaaaaattgtatttttattttctgctgtttccccaaaatatttttcttgttttgtttcttaaagaccatgtcttgttctgtcacccaggctggagttcagttgctcagtcatagctcactgtggcctcaaactcctgggctcaaaccatcctcctgcttcagcttcctgagtagctgggactgtgagcacatgccaccatgtttggttatttatttatttatttatttattttttgggtagagacagggtcttgctttattacccaggctagtcttgaactctcaccttgacttcccaaactgttgggattgcaggcatgaacgccgcacctggcctgttgatttggggtggagcgttctgaaattgaggcagtaattaatagcctaccaaccaaaaaaagcccaggaccagacagattcacaactgcattccaccaaagttacaaagaggagctggtaccattccttctgaaactattccaaataatagaaaaagagggactcctccctagtccattttatgaggccagcatcatcctgatactaaaacctggcagagacacaacaaaaaaagaaaatttcaggccaatatccctgatgaacattgatgcgaaaatcctcaataaaatactggcaaactgaatccagcagcacattaaaaagcttatccaccacaatcaagttggcttcatccctgggatgcaaagcaggttcggtgtatacaaatcaataaacgtaatccatcgcataaacagaaccaatgacaaaaaccacatgattatctcaatagatgcagaaaaggccttcaataaaattcaacaccctttcatgctaaaaacactcaataaactaggtattgatggaacatatctcaagataataagagctatttatgacagacccacagccaatatcatactgaatgggtaaaagctggaagcattccctttgaaaactggcacaaaacaaggatgccctctttcaccactcctattcgacatagtattgaaagttctggccagggcaatcaggcaagagataaaaataaaggatattcatacaggaagagaggaagtcaaattgtctctgtttgcaaatgacatgattgtatatttagaaaaccctgtcgtctcagccaaaatctccttaagctgataagcaacttcagcaaagcctcaggatacaaaatcaatgtgcaaaaatcacaagcattcctatacatcattaatagacgaacagagagccaaatcataaatgaactcccattcacaattgctacaaagagaataaaatacttaggaatacaacttacaagggatgtgaaggatgtcttcaaggagaactacaaaccagtgctcaaggaaacaagagacgacacaaatgaatggaaaaatattccatgttatggataggaagaatcaatatcatgaaaatggccctactgcccaaagtagtttatagattcaatgctattcccatcaagctaccattgactttcttcacagaattagaaaaaactacttcaaatttcatatggaactaaaaaagagcccgtatagccaagacagtcctgagcaaaaagaacaaagctggaggcatcacactacctgacttcaaactatactacaaggctattactggtaccaaaacagatataaagaccaatggaacataacagaggcctcagaaataataccacacatatacaaccatctgatttttgacaaacctgacaaaaacaagcaatggggaaaggatttcctatttaataaatggtgttgggaaaactggctagccatatgtagaaaagtgaaactggaccccttccttacaccttatacaaaaattaactgaaggtggattaaagatttaaatgtaagaactaaaaccataaaaaccctaaaagaaaacccaagcaataccattcaggacacaggcatgggcaaagacttcatgactaaaacaccaaaagtgattgcaaccaaagccaaaattgacaagtgggatctaattaaactaaagagcttctgcacagcaaaagaaactatcatcagagtgaacaggcaacctacagagtgggagaaaatgtttgcaatctattcatctgacaaagggctaatatccagaatctacaaggagcttaaaacaaatttacaagaaaaaaagaactccatcaaaacgtgggcgaaggatatgaacagacacttttcaaaagaagacatttatgcagccaacagacttatgaaaaaaagctcatcatcactggtcattagagaaatacaaatcaaaccacaatgagctaccatctcacaccagttagaatggcaatcattaaaaagtcaggaatcaacagatgctggagaggatgtggagaaataggaatgcttttatactgttggtgggagtgtaaattagttcaaccattgtggaagacagtgtggtgattcttcaaggatctagaaccagaaataccatttgacccagccatcccattactgggtatatatccaaaggattataaatcattctactataaagacacatgcacacgtatgtttattgcagcactatttacaatagcaaagacttgaaacmaacccaaatgcccatcaatgatagactggataaagaaaatgtggcacatatacactgtggaatactatgcagccataaaaaaggtgagttcatgtcctttgtggggacttggatgaagctggaaaccatcattctcagcaaactaacacaagaacagaaaacctaacactgcatgttctcactcataagtgggagttgaacaatgagaacatatgggcacagggaggggaacatcacccactgggacctgttggggggtgggggacaaggggagggataacattaggagaaatacctaatgtagatggcgagtttatgggtgcagcaaaccaccatggcacatttatacctgtgtaacaaacctgcacatgtatcccagaacttaaagtgtgtgtgtatatatatgtgtgtgtatatatatacacacacacacactcccatatatataaatatatataattatgtatatataaatatataaaaatatgtatgtatatataattatgtatatataaaaatatataaaaattatatatgtatatataaatatatatataaatatgtgtgtgtgtatatatataaaaatatgtatatatatgatgcccagcacactgaatgtattagctgccattttcattatcttcattggtaagttgaatcatatgagattgctggtatttgactgctcttgacctataaaatggtagttttgtacggttcagtctaatattacgcccttcagatttatctggccagttgcatcttctgcatttcctgagttcaactcaggatttttttctacatttgttagagaatctatcttgttgaagttcaaaaggtgtggtatgcattgtgcatatggtccaagaacatgcttcttacccattttttgtactatgtagttagtggaaataatgccttgactttggctgctttttcctcgtatatttttagtgctattgccaatttttgtctttgtgtgcaccttcttgagcattttaactggaaattgtgatgagttttattgggacatttagttcagtggctttcaaactttttagtcatgacccatagttagaaatgtttgtccatacatttgaatgagacattagttgtatatagtttactacacatagtaaactctgacattttcttttctattttttcctatgataatttgttcattttcattttaaaaagtactggttataactcatacattttgaaaacacttatctagtcatgaactgcagtttgaaagacrctgatctagtctgttgctgtgctgtctaaaatcaggttcattcatttttcaacatccatttgttaaatacagtatcggttattttgctagtagctgggaatagagtgatgagtaaagcagtcgttatcactggtggcatgaagcatagagtctagtgggatggagcatatgaaccaaaaaaaaaaacatcsaaatgtataaatactctgcatgataaattctgtgggggaaaagagcaaaagcgattaaatggggaacctcatctgactttgggggtgattcaggatttccctggggaactgacatttggttaggtctgcagatgagaatgtgttaactctgtgaaggactgagcaggggtgtgtgcgtgggattgcagagtcatggaagaaatagtaacagaagcaaaatagaaaaccggaagggaaagacaggtggaaggcaatcttctttgatgagttggcattttttgtgatacttagtaggccttcctgtttgtggcttttttttcttacttgacaaaagtcaaataggaatgtcaaggattttttgggggagatgggtgttggtgtttgttgaagtagttttgtattagagcaatatagtatattgctaaatagcagggtttttttttttttttttttttttttgttgagacggagtcttgctgtgtcacccaggctggagtgcagtggcgcgatcttggctcactgcaagctctgcttgccgggcacgccattctcctgcctcagcctcctgagtagctgggactacaggcacccgccaccatgcccggctaatttttttttgcatttttagtagagacagggttttaccgtgttagccaggatggtctcgatctcctgacctcgtaatccgcccgccttggcctcccaaagtgctgggattacagacttgagccaccgcgcccggcaatagcagggttttttgaaggcttgctctgtatgaggagctgtacaaagttgtgttcgatatgcaggagaaatagatttggttggattaaaaaatacttttatataatataattaccaatttagtaactatgcataatttgtaagaaattataacactgaagttaagttttttgtaagtgaagatcagatggttgggtgagtatttcattgcttcttgttgatttgaatataatggtaagaattattactgcactaggatttttgttttttttaccttggtaggattttagtgttcattccccccaccctcttttaaaactgaagagtttaaaagaaagattttaaattagaagtccataaagtaagttggagaccacgtgagatgggagaccatgattcaattgccagttcttccattgctgtgcatgatacccttgacaatacccaacctttgaggccctgggagccttgtcttaaaatggaggacttgaaatcagtttgcaagaatcattctcccagtcctattattagtattaagtgcctttatgctttctattttcaactttgctctggctgtttaaagacttggcaccccaccatttaactaacctagtccaacaagctcaggccaaacttgggagaactccaggtatttgcatctttctgtgtctttgtggggtcaggctcaggtggcactaattccttcacattgggcaacactactaatgcttctcattacaacatggaagaatgggtaaagattagaattctcttgagacttttttttttttttttttttttttgtgacggagtctcgctctgtcacccaggctggagtgcggtggcrggatctctgctcactgcaacctccacctcccgggtggttcaagcgattctcctgcctaagcctcttgagtagctgggattacaggtgtctgcccccacactcagctaatttttgtatttttagtagagacagggtttcaccatgttggtcaggctggtcttgaactcctgacctcaggkgatccacccacctgggcctcccaaagtgttgggattacaggcgtgagccacggcaactggcctaaatcttttaaractttatatcatagtttgcagtttgacaacacttggaattaattttttttatcctttcagattcascaaacatggaaaaatatgattatcttatgtttatatgctggatgcttgctttggagaaatatgcagcatctaagttatatatawtccacattttataaaaacccattggatgagggtgatattattttaaaaarattttaaagggctaaggaatcatatggaagatgaattcaattttaatgactacaccaagtttaaggaatattttataagaaatgggcttatgtgaaagagaattaaaggtacttggcaattcagcttatcttttctttttcctcctagctttattgatgtataatgacaagcaaaactgtatttaagttctacttatgatggtgatatacatatatactgtgaaatgagtactattaagtatcgtcaccatgctgtaygttagatccccagaacttactcataactggaagtttgtaccctttgaccagcrtcttccctttcccccatcaactcagcttttcttaccagtatattaaatcatttgattcaaatacatttcaacattatttttttgtaattcaatatattcagtctttcaagttcatttattgtaacgtgaatatgttattacactcgttcttattttttgtttagaaatcgagggaagaaagatgagatgcatgctttttctgtttgtctgaactctgctgaattcctcattcatagtaaaatatttactcaggaagtccaggtaactctggagattttacttagtgtgttttggtgctgattcatcagttgatttttttaatttgttgttaaatatcttcttaagctgattattatatggaaaccagccaggactccaggctcctgatctgagacaaggcaggggcaggtcayacaggcacaggcaatgtttggcaatgtgtaggtccaagtaggtactaggcacaggtgctcaatgctagtactagaaacaggttgggtstgaaggggctggggtcatggggttagggtaggttcaaggtagacaaagccaggaagaggcacagagcatgtagatgcctggyctagaattccataaaaggcattctggatagccctaagagagaagtggtgtagacaaaagtctaaagctcccaggagaaatttattttcagagttggaagcatcagttgaacttcgctgattgttcaagggaatctcaacactcaagcaggggtttagtcaccatgaccttgggacaaagtcccagcttctcttcaagtgtttggtcatcttaaagtagagggctttgaaatcacaaattctcatctgattcagggattaagaaccttgttgaatactatttctctaggagcaggaattagctgaggtctcatgactaaatgtattctttctacaagagatttattataaaacatatttaacatttgctatggactggattttctccctaatattcatgttggagccctaacccccagtgtagctgtatttggagataaggcttttaggagataattaggattaaatgagattataagtgtggggtcctaatctgataggattggtggccttatgggaagaggaagagagagatctttgtttctatacacattcaccaaggaaaggctgtgtgagcaaacagtgaaaagacagctgtctgcaagccaaaaggagagccctcaccagaaaccaaccatgctggcaccctgtattacatttctagcctctagaattatgagaaaataaatttttttcatttaagccacctaacgtatggaacttttttttgagacggagtctcactctgtcgcccaggctgatgtgctgtggcgtgatcttggctcactgcaatctccacctcccaggttcacgccattctcctgcctcagcctcctgagtagctgggactacaggtgcccgccaccaagcccggctaattttttgtatgtttttttttttagtagagacggggtttcaccatgttagccaggatggtctcgatctcctgtccttgtgatcygcccgcctcggcctcccaaggaactttttaatggcagcctaagctaatacaacattccactaatttgggtagggaataaaagtaactctgtccagtagccgttcagcagaaaacacacactatcatttacctgcctaactctcttcctttttccttcttcatcccgttttagtggcagaatgactcagtgagtaaaaatgttccagtgaacacatcttaaagtatttaaaactgttcaacttatttaaaaccaattgtttttatatgaaatactgtttattatcttttaaaatatatctctattattattatttttaatagagaaggtgtcttgcgatgttgaccaggctggtctcgaactcctgggctcaagcaatcttcccaaagtgttgggatcagaggtgtgagccaccatacctggcccttagtgtattcttaaaaacattaaaaaaattatttttgaaatcacattatggcaatatttaaataaacccacttgtatttgcagttccctaatgaatgtatttgttatttagtcatgttagttttatggcctatttctattatgttctattttatggtctacttctacctagaagtaacaaatgtgtgtttttatttctactgattgttttttaacacactgttatataaggcgatatagtctgaatcatatttttartagcctgataataatccattaagctgttaaactgttcattcaaccattgccctatttttacacagttttatttcctttgtacttgctgttttaaaaagtattgtactcaacaacttttatgtaatttccgtagactgattaagagtgagatcactgatttgaaagtaatatcatttggtttccaagtagattttaaaaggtagtttaaaaacttaactttcaaaagtaacacctgtttgtgctcattttagaaaacaaagaaaaatataaagaagaagaaggaaaaagtacccatactccccacctagagatagccattgtcaagtttatgggatattcccttttaatattttctctgtaaattttatctagttggaatcctactgggcataatcagtactttgtcctttctcttaatagtatgcagtaaatggaagtgatgttaattccattcagctactgttatagtgaactcacttcagtaaatatctttgcaagcctatttttgcatttcaggtaatttctttagagtagattcctggtaatataatttgttgccttaaaaggcagggatgatttttatggctagagatagaaatgattaaattgatttccaaaacaatgataatgcttcatactcctaccagcagagtttgagaaaaacttaaagatggaaattagtataagtgaaatgtgaaatgattagagcaatgggaaactttaataataatctgtcctggatgacattgactagacctcattggtggatgttctctccactgtggtcatgtctttcactcatccacagttttgtcttctaacagagaactttatgtttcaagcttcccttagttttatgtcctttaatatgctgtgaaaaagtttttttttgtttgtttgttttgtttttttttagacagagtcttgctctgtcgccaggttggagtgcagtggcgccatctcggctcactgcaacctccacctcctgggttcaagcaattctcctgcctcagcctccctagtagctgggactacaggcaggcaccaccatgcccagttgatttttgtatttttagtagagataggtttcaccatgttggccaggatggtctcaatctcttgatctcgtgatccgcctgcctcggcctcccaaagtgctgagattataggcgtgagccactgcgcccagccaagctttgtttttaactgtatacactgcatcaactgatggtagggtattcctgatgagtatacttctgtgaaataactggttaactactagaaaatggagcaagtgctctaaaaatgaatagcaaagaattaaaaactaaatggtaattatacctgtgctggtttagtgtgtattttgcatatttacccgcataagctcaattttcttctagatgccattgatattacagtcagggaccacttttgtgccttggggaaataaagtgagcttccttaggaggtaatagatttgcaatttcacccattactggaagtagtcacatgtaatccaattaaatttgatatctcattagtgatggaggcccaccttcaaaaaactcagactcgagggatgggaactgaatgaaggtaccatgtgataaatgcaatgttataagttagttgcatgtctgttttcctactaaatatagtgaaatttaataagcataggaaggaaatggggtaagaggaagtgagtgtgaatttaagcagagaccgagaccaagggcccaccttagggtgctattcatgtattagaaaagggccacgcattttgctgttcttcctcatagttgacatgaagaggggactcaatgagctgtgttacccagaaagcccatgaagataaggactaaccaggggggacaactcttcatgtgctgggaggagaactcttcatgtgctgggaggagagaggattttatccatggttctccaaacgttaggtactttaatgtattgagtcgtgtctccaaatacaatcttacaatgaatgtgacaatggggttaaaaaaaactgtattgctcaatataggttaatggcataatgccaattgcttatctcagaaaagccattctgtaagagccaaagcaagacagttcagacaagcagctcactgctggctctgtccaagcatagacattccacattctttgtggagtgctgaattagatacttttcaggatgttycctatgaatattacttcatgcaaaaggatatttttgataagaactgagtagcagtaagttcaaggttattaagctcaatactgcatcctctctttgtggtcagttaagtgtgggttcctgtgctttaagcattgacttgactgagagtagcatgaacaaagatcagcctatgagcacggattttgtggagtctttttacttcagggagtagaaggaagagaaatgaaggctctgacagttgatgcctttggccagagtttgcaagactggaagtctatgtgctaaatgaatttggccccacatacagtttatttgttcaggtcaagtttcaaaagtcagcatagacaggtgggcattatgattgttcctcgtgcaagtgtagtttctgtatcatggaagctaaagatctgttttcattggcacttcatgtatttatgatacctggttggtccctgtgggtatttgtgcttgtgacatttgctggtatatggtcacagtgtaatgatgtatgtgtaagttcagaagcagcatagaggaggtggtgattaatctggrtggggaataggacccataaaaggcttcattgaaaggctgtgactggaaagatgagtagatatttgccaggcatagaatttggacaagggagggtattccaggaaaagccaagtgcatatgcaaagacagctgtgtggattagcattatatgttaggggatttctgagtagatccaaagtgctggggcttaacaagcaaggtgaattatagcctaagccagaagtacctgaaggactcagtttgccgtgcatgaggaggctggccttggggcaatggggaaccatgggaaggtttgaaacagatcattgccatactagatttctgttttaggaaggttattctccaaacacccaggagaaatagttgcaggtagaagggactagaatagctttttaaaaaaagttatttatgaaaacatctttatttttcctccatttcactgacctatataattttttatggtgagacgtttgaaatttactcttattttgaaatatacaatgcattattattgactctagccactctgctgtgcagtggatctcagaaagaagctattcctcttgtctgtctgaaactttgtgccctttgatcaacaactccctatctcccaccccactgttcttcatcccttgcctccagcctctggtgaccatcattctaccctctacttcttggttcaactttttaagattctacctataagttgagatcgtatagtactgagatatcttaagagggcttgagttaaggcagtaacagtgggtttggagggaagaaggtagatacgaaagacatttaggaggaagaattgatgcaacttggctattgaatagatatggtgggtgagggagggggaggagtgatagtgaatggatgacaataccgttgaatgagacgaagtaggagagagtaacaaggacatgggaagtgtatttatattagattgccagggctgccatgaagtcccacggactgggtggctgaaacaacaaaaatttattttctcacaattctggaggctggaagtcatagagaattgtgaggactgttttcttctgaggcctctctctttgccttgcatgtgatggtctcctccccgtgtcttcatgtggtttttcgtttgtacctgcctgtgtccaactttcttcctcttataaggaccctagtcatattggattagggcccactctaatgacctcattctaacttaattacctctttatagaccctggctccaaatgtggtcacattctgaggtactgggagttaggacctcaacatatgaatttctcggggggacacagtttagcctagaacaggaaggatgaagagtttggtacatgttgaatttgcaaaccctatggagtatgtagggtggtggtggtggttctataatgcatttggatgtgtgagaacacagcccagaaaagaactccagatttggtatttaaaatcatgggcatggataaaaattgtcttcaccagtaatacccaaccttggcttattttaagaacacctgggggagcttttgaaacatgccatgtgcagggggctcacttcaggccatgactcagtctttgaaagagaggccagggcagacacctggtcattctaatgtgatccaaggttgagaggatgggtctagtgttaagtgtagagaagagatccgaaagaatggctcggatcattcaagtggtggttggtaagagagagagaaggatgggaaggatgggagtttggggggcttcttgcctgatgtycatcaacttctccatgatggatgtgcaaactggggagttcctttaggggatttaaggcttggaagaggcgccgagagaaatggcagcactgatggcttctctttttgggctcacctgagattagaatgcattcattaatagtgacagctttaccttgtccttaagttttccccacaaggcctctggaggttgtgaatgggagcagaacaggcagtttggagtttaatcatgattgtggtgtcaaagggcagattggcagaaaggagcatgggagrtatcaggctggtgtgaggggagcccagagggctgactatggtatttaggctgggcattgtgagaattgaccttggatagggctggtgaacaggaaagaatggagggagcaggaggctgggtattttggagggctgaaataatgtgtatgagcacaaacagctgcatagatgcatagtttcagctataaagggggattttgaagtgtcacaggcaattctgaatgatgaggggctaagtggtatagtcaattcagaaactaacttgagaggtcagactgttgggtgtgatgaaattgcccttgataatgacttgcttgatgattgagttgtttgcaagagggaatgaaggttggggaaatttactagataacctttaaggtttcttccagcctcaggatttaacaaaatgtcattgttttgtgtcacggctccctgatcaccctttttttctttttctttttggaatcagaatagagcaatctgaaaaatgccatctaacaatcccatttttattgatcccattgtaattgtaaatgtttgacaggttatagcctctttaaatgcccttggaatccattaacgcrtgtttcatagagttcacacagggtaaagtggtactttggtcagaacatgstttgctgaatgtcactgatttgtctctaccacacagctggcttctgaggcttataatgggcaattaggacaggaaggagttacttaagttctttttaaggtaacattaattrgattcatctcttaccacatggtgagggtcatggttattacatttaccattttgggtttggtgtttaacctctttattgtggattggttggtcctggacattttcagatttagttttgtggtaggatgttttgtctgtagtttgcgtgtgtatttagaactggaatgaagtgtactttttaaaactacgaccccaacagcaaaaaggattttacaagcacttttggccttcattgttagagtgtcttcttgttctatgaggaaataaatttgatccttatcctggaattaaaaaaaatccttgaatgtattttttgttgttcttgttgcagcaaatgcagatatcagcgattttcatgacgagtttgcttatttaggggagaacattttctaaatcacgtaaagcttaacattaacagaagaaaatttgaaaattaaaattttaagagtgaaattctagacctttcacaaagttacaggctgaatccagctggtctgtcctgtccagtcacaggaattcccgcttactattaaacgaaattttccttccttcttcctctcctttctctttccttgccttttcctctcctctcttctggcatatttctctcaattgaacagtttcttagttttttaccaccaacctcaaaggatcaagtgtgaatgaagtaattgctttattttaggctctttattttgccccatcagccccatttaaaactctgtctcatcctcctaccacatcccagatattgttttcttctttaggggacaagcttggactggaactgaaagatgtgattaccagggtcttgttctaatcctagctttaccatcaactgagaccaacccagattcaattctgcttttgtggactaccaggatactgagtgtgtatgtgtgtgtgtgtgtgtgtgtgtgtgcgcgcgtgcgtacatgcatgtgtgtgtttgtgtttgttaaaacaataacaattyggcaagcataggataaggyattggttttcactgtttactgtcatcagaaatgccagagatgtgtatttaaatgcagagttttcagcctgctcacagtgttcacaattcagataatttgggaaggatccaggactctgcattttttgtttgtttgtttgtttgtttgagacagggttttgctctattgtccaggctggagtgcagtggcatgataactgctcattgcagccttgaactcctaggctcaagcaattctcttacctcagctacctgagtagttgggaccacagatgtgcaccaccatgcctggytaatttaaaaatttttttgtagagacagggtctcgctatgttgtccagcctggtcttgaacacctgggctcaagtgatctttctgccttggcctctcaaagtgttggaataacaggcatgagccattgtgcctagctgagactctgcatttttaacagacaactggtgggccacatgttctttgagaaacagtggatttggggactttagttattattattttccatctcacggtagcagcatttttcaaagttgggccaatttgaaatgactgttttatcaaactgtagacattttgttttcattataatgtgctctctaaacacctcatatccaaacattaagaacaagtgggcttcatcatattctggactggtcagaactagccagcaagggtactatattgtgttttaggtgtcatccttgaaggatagaataaatcagctgtcgtgttctcagtgaaaagtggaaagaagttktaaaggatctgcaaaatagaattatgagacagaggaaagaaagaaacagacaatctgatctctatcttcatcggccaggtaagatttgaagtgtttaaagaacgggattcagtttggttacaaaagagtagctgggtcccagggatgggtttttcagttaggataatctgaactacatttgagagagaatttctagcaaactgcctgtccaaggatctcatggctggccttggaaggtagtgagcttcccgttattggaagtgttccagcagacatagagaatagattctgcagtgactaaaggattggataagatgtagaactagacctcagaagttttcttccaatgatgagatgctataaattttatgaacaacatacttaaaatagctttaagacactctacacgaattcgaggctgaaataagactagttaaactataatcagtcaattgattattaaaaccaagcacagacttacacccactacatacacttatgctcacaaatgataaatgccaggatagtttggattgcctttgaagtttattatttgcaggtgtagaagctcttaagttttagtttgtagtgtttctaaaagtgaggcattctcttgaactgtctttgatgatttgatgttcatayattatgtctgctgtgaatttggaaagcactgcagaatcactttttcaaagatcagaggaatgtgggatagaataaattaagtttctggctaatatttggtattcttctttagggatatgctttcagagatctgtttctggaaggagaagggaagtcatgacattttatgtgaactcaactgggcaatgtgaggttttcctatcattagctaataatatacatttaaagtcacatggaagtgtgttgcctgtgatctgaatttttattcctaaataaattagagattaaaatctgtggtttccagttcaagggtagggtaccaaaaawawttgtctgatgtgggtttttatgtcattaagaaaggcggcaacagctaagtattattggcttttcccttttcttggttgcactggtccttttcccttatcttgaaaggcggtagtaaatgttgactttttgcctctaattcacctcaatgattgtacattttaacatgttttaagataggtggttttagcccctaccttattttcctggtctcttgcttccactgctctggttcccaagaatcaaaattgaggccagatgtatgttaacatcaagaaactctgactggcgctcttgttctctccctccccagatattaatgcaagaagggaactaggacaccaggaacagccactgttaacattctcctataatttctgcctgttattcctctgcaagacctttatgagagctgaatgtatttttgttctgtgttttaaaattttaacatttaaaggcagtgctttcctgtcacattgtaagtctctgaaaacattgtatataaatatatagatatattgcatatttgttttcaattttaaagtgggattttcttgcacaaaggtttgtatacaattctatggccaactgacctatctatgtatccatatatatatatatatatcctaattatgaaatgagaaatgaaaatatgtaaagtgtaaactatataaacaacaaaaacaaatgagaatttgtaaaatataaaaatcatagtaacttagcatccataataaaatctctattagtgtttgtaagtaccaagtctttycccctccatatttagacatataatttattcaattattgattagaaattataggtaaaaatcatccaaatcatgcaaattctgaaaaactagaaatagcagctgttaacagtattggtatatgtcccttcatatactcaaatacatatatatatgcccagtattattttctattaatttttaaataactttttttactataaaagtgattcatatataattcagaacccctggaaaatataaaaatgtaaacaaaaaatggactgaaatatttccactcaaacataaaccaatcatttttaccaattcttccaaatatgtacacttatgtctgtaaaccccacacttttcaaaaaataaaaatgacacaagtatatattgctttgtggctttttaaaaaatatttaggaatgtatcaaacatttttgtgttaataaatgctcaataaaatttgttttggtatgaatttttttttttaaatctcattcctgactctaaacctcactttgagatttcccatctgtgcctctgtgtaattcgtttgtagtgatggtccactttactaattatctcttcagttgcacttaatcagctgtattactcacctactgaatatctaatttgaaatactgtgtttttatatttctaggaaccctgtttctatttttattttaggaaccctgtttacatcttcttaaaagttgtaagtcatttttaatatattatcctttaatatgtcctcttttacttttaaacttattaaacatttttattttatagtctgtattggataatcccagtatctgtagactttgtaagtctgcttcgactgtttgttctttttgatgactcttgtaaatgttgacttgtttctgtatgtgctttgcgatcccaccccactccccattctcccaatgtaagctcatgtttctaggaactttttctctgggaattctttgagagcttaaggtgaatcagttcagaaagaatttgtgttttcttctgtttgatgcattaaaggcactctcaacccatgtccacatcaggttgaattattagcttgaggtttttgggtggctacaccagcagtaggaattcaggtcatccccagtttattaagggcaagtgtccggatataaattctcaggggcgactctttcctacctagatccatgtagatccatgtgtgagacagtcacattttctgaccctctccctgtgtgacttgggtcagtattttttctattagttcagctgttaagggtaggatgtcccagctttttgcagaggtctttgatctgacttccatttttcacttgatttctgcttttaaaagccaaaactcaaggtcacctgggattattgggatataatcggctgacagactccctagtttattattgttatttttttcttttccgagttgatttcttgattacttttgcttcttgggagattcatgacttttgccaacttgggtaaacatttacagaggtggaggtgtgtgcttatgtatgcatacacacacagcagttttacatgtttttgtgctagaagagttttcactgtattttgctcttagtattctgggaaaagacgtctatagtgtgacttttaaaatagcaggacatattttgtccttcaaatatattgttattaataagattttttttttttgagatggagtcttgttctattgcccaggttggagtgcagtggcacaatcttggctcactgcaacctccacctcccaggttcaagtgattctcctgtcttagcctaccgagtagctgggattacaggtgcccacgaccacaccgagctaatttttgtatttttagtagagatggggtttcaccatgttggccatgctggtcttgaactcctgacctcaggtgatctgcctgccttggcctcccaaaatgctgggattacaggtgtgagccaccgcgctcggcatcttaaattaataccacttctcgaaaccttagggttgctttcaatttcccggatatagttttgtaatgattgtcttcaataggtatgttagcacagattgctgtttcttttccaatgataaacatcttgaagtaggattgctaggtcaaagggtgtgtttgtctggcttttgatacatattgccaaaatcatccttcagggacaggatgagatttttccatactgaaacccctgatcacagtgctcraaagtgcagcaacttcattaaactgaatattataaatttagaaagattatcaatgtgttgggggcaatggcattttatttttaaaattagattatttaatcactttaagttaggcacaattttttcttatgctcatcgatcatttgtatttcataaatttcttgtggatgtttatcaaccatttttctattgggatgctcatctaaaaatttacttgtttaagctatatatttaatacatataattttcgtttttaaactttaagaatgttaacagtttatgatgtgatataaagcattttttcaaatatgcatttgtttaatataatgaagctttgaatgtttaggtagtgcattaggccatttttatactgctgtaaagaaatacctaagactgggtaatttataaagaaaagaaatttaattggctcacaattctgcgggctctacaggaagcatggtgctggcatctgctcggcttctggggaggcctcacaaaatttacagtcatggcagtaggtgaagggggaggaggcacctcatgtggtgaaaacaggagcaaacaagcaccactgaaagagagagagaaagggagagaaggagtgagttagttggggtgaggtgacacatacttttaaatgacaatatcttgagagaactcagatcacttaccaccaagagaatgttccagaaccattcatgagggatctgtccccatgatccaaacacctcccatcaggccccaggtataacactggggattacatttcaatgtgagatttggttggagacaaatatccaaactattttaggtagttacctttatcagtcttttctttggccttatgctaaaatagcctcctctcaatctgtgactatataaacattctactgtattttcttctagatctcttaaggctttatttttcatactcaattctaatgcataaacatttgtttatgtgctataaagatttataccttatacccctgtgaatttatttgagttggcttgcctgtgtacctatttggaggtgtgatttggatcaacccaaattatttgggattttttttgtgtgttgagtctgtaacttttgaatatgtaattaccatggcatggaattggtaatatagatgtttgcacaggcaatggtgaactccaaattcatgatggaacaagcaggtgcgtgtgttaaggaagaaggaataagttaaaggatgtgccaagacagaaagttaattataatgcttaacctttagggatcatttccccaacattttgtatgtttctttttcttcctaatggccattgggaatggaatgtgtgggattgactaggaaggctcttgcatcatcaggattttcagtgacttgagaaagctgggaagattatattaccagcactttgtgtcttgtgtacagccttttgcatgcatgcatgaatgaagaaaatcatttgacaggaaatagttgtgttagaatacttgtgcttttgggcaaaccaattcttcagttcatttttcatttctagtggctatatgccttcattaattcctccttttattgttcaattaccctttattgagcactgtctatattgccaggcacactgagcattaggataaaaaaataattatagtgctggctttatcctcaggaagctcaaagtccagcagttgtctcataactgaatagggtttagtgtgatgaatgttatgacttatgtgcaaggtacagaggtgatggcatatagcagggcacaccaacacactgctgatgatgtgtgtgtggcagtgattaaggagactcctgagacatcagctggacattggaagattgaaagataaagggagttcaccttgtggataggcagtggaagaaggcattttaattgtgaaaacagaatatggaaggcatgaagtaacatgatgttttctaggaactccaggtagttttgttggtaaataatgttaagacttgctagtggatgaggcagaggctggatcaggggaggtcttggggaatgtacaaaggaatctgaagtttgcttcctccttcccaattcttctttttttttttttttttttttttttttttttgagacagggtctcactcgttgctcaggctggagtacagtggtgccatcacagtatactgcaacctccacctcctgggctcaggtaattctctcacctcagcctcccgagtagctgggactacacagtcacacaccaccacacccagctaatttttttcaccatgttgcccaggctggtctcctgagctcaagtgatccacctacctgggcctcctacagtgctgggattacaggcatgagccgtcacgcctggcccacctccctcccaattcttaacaattgaaaggatttccacaattttgttagatcattgcaggaggttaaattggagagagacagagagaaatgaaatgagattagagctagagaacttttttttttttttttttttttttgagactttgtcacccaggctagagtacagtgttgtaatcatggctaactgcagcttcgacctcttgggctcaaccaatgcttgcgctttagccttttgagtacctggaaccacaggcacacgccatcacacccagctatgtttgtttgttttttgtagagatggggtctcactttgttgcccaggcttgtctcaaattcatgggctcaagtgatcctcccactttagcctcccaaaatgctgagattacaggcatgagccaccgtgctcaaccaagaatggatttgaatctattaagttggaatgttggactacattctggaatgggatgcataattaagtatcaccagactataagtgtctgtggaattgattggtatggataagatggcctaaggagagtaagcagaagtagaataggaaagggccaagtacagagcttgggggtaagccaacatttcctagtcatcagaggaagaggatcctgcaaagaagcttgagaaaaggctatcacaaagttggataagaatcaagggagcatggtgttgtgagtagggcaaaattaaaacgagtgattaatgatgcaaaatgccaacagagggtcaagtaagatgaggacagagaaagaacctttttagaggtcagtgatcttaaggttttgagttggggtggaggaagccatggttcatcatataaaaatgtaaaagcaataagcacagtttcttcagtatcctgggccttgaaaagggaggatggggtaggggracgagagagaaggaagaagttggggtcaagggagtactttttctttcttgaataggaaacctagcatgtttatattctgaggactgggaaatgaggagagaacaaaactgaagccacagaagagagaataattgaatgaagtaaactgcagtgcaaaacaagatgtggccaattgaagactaggatgaatgggagagatatcttgcaaagtcattgttagccaaaattggtgacggtgactatcactggaggatcaagacatgcatttcacaaatgtttatgagcacaaagaactatggcagctgtgtactgggtgaaggatggagccttgattatgccctcatggaatgattagtttttcttaagtctgagttgttgggatgaacttcattgaaatagttaatgtgactttgacactactaagagtatgaatattacatgttagttggaatagtggtccaagacatatgcaaataaattcagttatttctgagttatgaattctgagcccaattatttttaccattatatttttgtttctgtgagccatataaatctgagatacagctggaggtttgggggaataattcctaggatatgtggctgcaccatctccccttaactcccacaaagaatggtttggttttcatggtccggctccttgggatggtggaggaggaagcttctgacctggccacactgcattggctcatgggtgactgccctttctgtgattgcagccaccactttttagtccctgatccccaaataatagttcactgtacttatcttaccctccccaaagagaaggagattttccttccaaataagaaaactctttagggcatcctcagggatgcctatgtgtttgtaacacttttagcacccaacatagccctttctcttttgatttgtggttcactctattaagcaaattacattcattgtccctagagaatgggttctaagtagatttgtgtgccaccctgctggtctcactcttgcgggcttttacttgagatgcgagggtgcatgtgttgactctgtcttaccgtggagtgttctggcttgcctactaaactccagggatagggacagccataatcctgccttctctgtttgtgactgaatctctgtggtttaaatactttatataaaacttacacatttcagctgattaataacagctatgcaggaacattcaattctgaggcaattttaatgtagtcgttgataaaatacaaactatcataataaaactgtttaatttacagttgattccacaggatcaggggatttccatttcaaatgggctcctgatgatctgcctggattcccagaatttctcatctgggtatacaaattaggtttcttgtaaccaacacttcatattttatttatttattttttttgtagagatggggtctcaccatgtggaccaggctggtctcaaactcctggcctcaagcaattctcctgcctcaggcccacagactgcygggattacaagtgtgagccaccatgcctggctcccttcatattttaaagagaagttacacctacagcgctttcgacttttgatggacacatctttctagagcatagttcttgcattcctcttttactgaaagttgttaattgctttgttccattagccttagcaggaaaaatcctatctctggagttttaggtcccttggtttatcttaatttcgattaggaataagagaatacctacctattcagctctcaaacagcaatgaatattgcactgtgttcatcctcattacctcccattattagtttacattctgggacactttttctatctttaatgataagttcattcagaaatatgttcccacattgagccatacttctggttttgtgtgattaactttggcaccccatgagtagtgtctgttaaaattaaatgcttgttttgcctcaagagagctagaatacatacacatattaccgtgatttactgttaagtgtgcagattgaggtggtttagaagtttaaaattggtttccgaagggaaatttacaagaaaagtataacagatgaatatgtgattagaactgcattccttttttaagtaaattaaacagttttattatgatagcttgtattttatcaatgactacattaaaattgcctctggaattgaatgttcctgcgtagttgttattaatcagctgaaacatgtaagtgttatataaagtaaaaagagctataaaccaaggagaaagtctgaagatagaactttaaaaaaccactgttatttccaggtaaaatatttaatttccaaagaaggttagcatatgttaaaagctwaatcttgttctgcatttgttggctacatttatatgaatttttatatggaagttcctatccagggtatttattagtcattttggaagtttttatccagggtattgattagttggcatcttatatgttctttcagaagctgtatgtattatttttaaaaatagaattctaattgagcttttaatctgtctgctgaatcaggaacattacatgactttctttggaggggaaggaagccagtggttagttttaggtataaaagagatcttcaagcacggtctttttaacttcytgtttctgtattatttcaggaaatagaggcagctttccctacattagattgttagcacagaataacagtagaagggttcagaaatgaagctaaaaggaaataagagaccagcatgatgctggagttcccctaggccagtcaaattatgttcaggcctttagtccatctggatgttagttctatgtatgatatgaagttggggtgtctgattaggtatatttttccttttgccttagaaccatttttttttccagtccctttatgtccccactgtaatgtcatgtgtatcatttatgtaagactgttttgaaactttgtgtacctctgaatgtctagcctggaacaattgtcacattaccttcattacatggcttttaatatgtcttactcattggtaggtcaagtcctctacttctattctcttaatttgtcttggctattttggtccttagcatttcactggaaatttaggagcaggtttatctatagacttccttggactttgaatttaaataatcattttgattgcaaataagggcagttttgactctttcactccttacatgttatttattgttgtcttgtttcattgaattaactaggctgtctagaactgtgttgaatagtaggagtaatagtgagattcttgttattcctgatattgaagaaaatgcttctaaagagaaccctattcctttttgaggagtattatttaaaacagctcagcatttccatgtgtttgattttagcatattaaaacataggaaacatgcagtgaacaaaaggggttattatgagcttagtgtaccagctgtcttaaggttttcattgttttagaggcatttagttagatttaattctgactccaaaatgaccgacctctctggagactgtattttgtaggagagaataagagtatttccattttaatggaaaagtggcaaagcttccttccacttcgtaatttttgtggacagtattccagcattgtccaacagatttttgtgataatggaaaatgtatttctgcactgtgcacgtaggagagcaactatcatattggacagtgtgggcctagactttggagttctaaccatgccccatttactagctgcacaggttcctgcctggtttcagaaggcttattcttttgggctagcacagctcacactgaggcacgtggctgggggagtagagcagtccttgctggattgcagccatggctctccttttagcctgatgcctttgtgcaagtgagcagctggcaccattgacaagggtgatcctggtgactacctctggaggctctggaccctgactgctgaaacaggagaaaaccctggccccatgcccctaagaagtcacccgatcaaagtggagcctgttgtttccctagtcacaagtcaatactaagagatttggctagtgacaaggaaatttttcatgttagaattcttgtacccagctctttttagaactggactactgttctcccatattcaggaggccatgaaccaaccagtagattgtttattgtgcttgctgatttatgaaaaaacttctttgtacagagcttctgaaaggggtaagagaaagggagaatagcagtgttatggactgaagaatgtgtctccctgaaattcatatgttgaaatctcagtccccaaggcgatggtattaggaggtgattaggtcataagggctccgccctcatgaatgagattmggggccttataaaagagaccctacagtcggtgtgttgactcacacctgtaatcccagcactctgggaggctgaggcagaagatttgcttgagctcaggagtttgagaccaacctgggcaacacagcaagaccctgtgtctactattaataaatattttaaaaaattagcctggtgtggtggcgtgtgcgtgtagtttcagcttcttgggaggcttaggtggcagaatcacttgagcctaggagtttaagtctatagtgaggtagatcgcgccactccagcctgggtgacagcaagaccctgtcctaacatgctcttaggagtttcataaatgtgaccccagaagagctctctagccctgtttccacttatgaggctaaattgagaagatcgcagaccacaaccccgaagaggcctcatcagagcccaactttgttgtcaccctggtcttcgacttccagccttcagatctgtaagaaagaaatgtttgttgtttaagccacccagtctgtggtagctttcatagcagcctgaactgactaagacaagtggatagctgtctggttgttttagaaagcagggctgcatggtgtggggatgctgctgctactcattcctgctcattccagtgttctggaaaatgaggtagggtgggggaggtctgaaccttctaatttatttctagctgttcttttttagcaattaaagcattcgttggacaccagttgcttttaattcagttccatctgcactgtacttaatagatattactcccaggttcttataaatggctggttgttattcttggtttcagagctattttgagtttttgtcttcatttgtattttgactggaaattgggtgtggacatattggggagttggggctgacatcatctttattcagaagtcactttatgaccatgtgcgggatatattaatttcactacagcttttgatcttaataaaatgtctctgggttgagctgactgatcacgaagattttaaactttaatgtttcctaagaggattgatacagccatccagagaataacatagtatataggagttatcttttgacagatcaagttccatttccaaatgatataaaacccacctgtgtccacatccttatgccttcttttgaatctatgatttgataacttaagaaatctatctatgcattagatattgcctttccggtagagctatggtgtgatcttatgctcatgaacagaaaatgaatttaagaatcctcagacctattgtccagttcttttctttaagaagaacttgctattgactttgtcaaaactaaatctgttgccttgggcgacaccctccaaaattcagattcagatggattacactaatagctttatgctacagatcaagtcatataatgtgaaggtacaattgcagctcccttattgttgtagacgcttgccgggatgaagttctcaaacttaacatgctcttaggagtttcattaaacatgtgtgtgtatttttaatgtccaggatttataaatggtaacacctgccctcagttcttttttgcactggtccacggtgtttcagttacagtctttattgaataattcaaaagttctctcctgaaacaatatttctggcagtccttataattgaccaggtggaatgaccttcagtttggatgaaagtccaatttatttatttatttaataaaattccaaatttgccttttctgccaggtattaaaagcacttaaaactttttctaatcaacaatactgaacacttcagacacttatcagagactttagtcttgaattatgtattattttaaattattatttccagttctattaaaggccatgtgaggccactgattttttaaatggacagtttagtgagtggttcttaaagtgtggccccatgagcagcaccagcatcacttggagatttgttaataaatgcaaattcttggatccaccccagacctactgaatcagacatgcagtggggtggggctcatacatctgtgtttgaacaagccctccagtgaattctgtgtgccacatattacaatttgagaaccactggtgtaatgcagtagttaacacacctagctttcaacctagacccactttgggtgcttgttaaaatacagattcttggttctctctcgcacagcatcttatgcaccagctttggagaagacacaggactcagtgttactatattctgcagtaaagcttgctctgctcaccttatatcatattagatcacttactagcaataaatgtagaatataatacgtttgttctagtccaagtatctgtgaagaactctgatttaagataatggcatgtaatcagacatacgcttcagaattaaggagacttaaaaaatacagatgtctagtttctactaaataaaaaactctgttaaaagtctggttttgttttgtgtttaagtttcatgggtgctataccatccaagaaccatttatttttatcttcagctttcattgagagttgataggagaagaaatagccatattaatatttttgtatattttataccatttgataactcttactaggaattagtagaagaaaataacatctctctctctcaatagttaatacscaactcttcattttcccttttgctttggttaccagagagctcagagtaaaattttgcactcagttttgaaatacctatttcccttgcttactttaatccatgactcttgttctttataatcttctgtaacctatctgaaacttatttggaagtagatggggccccaaaactaagtaaatgatggaatatctgccctttgctttgaaatgggcttcttgattgactctttcccagcttggggtcagtgtcttctttatatcatccttcctttcatagacacaatacaattgttggtagcctcactgtgaaagagttaatgtttcccaataccaggcactgacataggcagtaggaaaaatctggttcattttgtttcaaaatacaccataccacgaataagtacaaacagctgcaatttgggcttggggccaaaagaaatcagtgtggtgctatgaattccagctgagaggaggagttcatgtaacttagatcagagatcagtctctgtaacgagaccatcagaccccagaaggggaagggtccttgtatgtcacttcagttacctccatcgctaccaccaaaagaaactggggtagttctttggagaggtggccttttagaaatctaaaattatacccttggagccgcttctctgcaattggctgaacacatcacattttatcccttgcccccagcactgtattactgtaaaatggggaaatctgggaatacaaaagatttagagacttgccacctgctcattttatcgctatgacttggcttaaaacaacagtcgctgtaacctcagccctttggcacacgcttccttctcaagccccaggaaattcttggtcaggtcgcacccacagccactgagtctggttgtttcttcttctcccagattttttagggaatatcagtttagtaaaacttatttttttgtaagcggactccttttgtatcagaattcctttcctttaaaaaatatttttatatttaytattattttttaagtagagatggcatcttgctatgttggccaggctggtctcgaacccctggtctcaagtgattgtcctgccttggcctcggagagtgttggagttacaggcttgagccaccacacccagcccagaattccctttctaatgtcataatgccttatctcttttttggagtggtcatcaaatcccttttcacactagttagaagttttctgtgtgatattctccattctctacatatttggactatcccactgtgtttttctggacatgtaggacagcatctttcaggcccattagcagatagaagtctttcaagtggggcctcacagctgtttttaggtctccggttggtttttaggtcatgtctcagacataggggctttgtggctactttgtggttttactatctcctcatagtttattaaaaaagaggctccttttcccttccattttctactgctttcctgataaaagacttcagccattatttttaaaagtgtccgctattatattttaaaccctttcataacaggaaaacaggagttaaccactcacataagttagagaggggaccccccttttttggtgattttcatagttactaaatcattgtgaacagagaaaagtcacttaattccctttgcttcacttcctgatttcttcaacagagtggtaacatttgagatgctattcatagaattgtatatcaaagaatgaggccagctctttcttggtgctccctcaagttggtaaaatcacgtatgtgacttctcaggaagccagagtatttacatatcctcgacccagctgggaataattcatcctctagtacaatactagttttctttagattcccctctatatttactgttttagagaggtattgccaagagggttttcaatgaggaagaatggtaatatgctgggagcaggaaaggaaatgaaattaagcgtctcattatttttcccatgctgaagtagatattaggattgtattccacaggtcttattttcttccccctccccacctcaaaacttcaggcaggatgtataagtctagacttaggttatatactgattttttttaagcttttatctccagtttaattagaggctggtgaaggaaactgggtttcttatttggctctcaaactttgaaaataaacaaaactttcatatatttgaatagcacattgtgggccaaacaacatctggaagagattagtctcactggtaggcagaagaaatttcataatgtaccatcttcaaagaacatggtacctcgtcacatttctcatgtgacatgtatcctggaaacagaagtacttagggccacattgctggagcatctgcctttgtctttgttttgtgtttaacataaatgtgtctttctaatactatgatatttctttagcttttttgaaaacacagctaaacttggtggtacgatgctgcctgcgctgttgactgtggtctagacttctcctttttcagaagacctatttgacttttggcaacgtgcctcttagagtttgtgatttgtttgagacatcttttcctgtcttctctaaaatcaggcacatatgtgtctggggtagtcatgtactttgtaacagtcacttttagccagatcttggggatgtctattcttatggttagtagtgacacatgaaccctctcttccacttaaaattattttatgtaagatgactgcttctccttctatccctgctccttcctctcctcctcctctactctgcctccctcaaacttatagaaaagttgcaagtacagtaaaaaagtgtgaagaagcttttatctccctaagtcaattaagagtgaattgtttacactgatgcgctaacatcttcaaatactctgtttttctcacaaacaagcacattcttcaacatagtcacaaagcaaccactgaaatcagtaaattcaccctattatcttactatcatctaattatcagatcccattgaaattttcccatattgtcacaacaatatccttgatagtgaaggatccagctcatcatcttgcactgtatttataattaggtcttttctaagtctactttattatggaatagtttctaacttttttcttggcttttatacccttgatctcttgattataggctgttcattgtgtagaatgttcctcagtgggtttgttacatgtttcctgttgattaaattcagatttcaaacttttggcaggaacatgacagaagtgatattctcattgcattttgtcaggtggcacacactgttgatttgctccattattggtgatgttattttgatcacttgattaaagtgatgtcttccagacttatttactgtacagttattattttgcactttatggtaagtattttctagggaagtgtttgagtctttgtaaatatcaattttttggtcaaacttttatttgtattaaaatgaacttacggattcctttttcattttcaaacttagaaataattagaccagtgagtacctttcaaactagtttccttgtcctttttacatgtctgcataattcttttaagtgctgtcttaactgtctgctcaaggtaaccaaggcatcatgtatttccctaatctgaggaacaggcatatctccaaggagcctggcacctttctgtagagaatggtattaagagacgaagatgtaagtgttaggtgtgctcattgttattgggatatcactattcccaggcttctcactgtgcaacacacacattgataactgtttttatttctatttctattgaaaacctctctccttctctcctggattacctctttctttctctcctggttgacccctcacctttcaggctttgacacaaactctgggctaccttcccatggggacatcctcttcacctcacttagactctgacactctgcgttgggctgcccttggagccactgaggaacattctacacaataaacagcctataatcaagagatcaagggtataaaagccaggaaaaaacttaaaaactattccataataatttttaaaaattagtttgtggtatgagaacacatggacacaggcaggggaacatcacacaccaggggcctgttggtgggtgaggggctggggaagggatagcattaggagaaatacctaatgtaaatgacaagttgatgggtgcagcaaaccaacatagcacatgtatacctatgtaacaaacctgcacgtggtgcacatgtaccctagaacttaaagtatattaaaaaaaaattagtttgtggttagtggtcatattttcttgtatgccagagttttccatttaaggagaatgttctttaaatattacattttaaaaagttgtaaaatagcgtttttctttaagacttatgctttcttttaattttttcattgataacatagactacatatatttaaagtatacaatttgatttgttttgacgtatgcatatactctcgaaattatcactgcaatgaagatggtgaacatatccaacactcctcagcttttctcctgttgtttgaaatccttccctcatgtcattctgctcttatactcccaggcaaccacttaattgcttttggtcactataaattagtttgcattttctacagttttatataatggaatcatacagtaagtgttgtgttttgtctggtttattttactcggcttattttgagagtgatagatagtattatacataccagtagttcatttgtttttattgctgggtagtcttctgttttatggatacataacaatttgtccattcatttatgaatggacatttgagctgtttccagtttttggctatttacagataaaactactagaagcatttgtgctcaagtctttgtatagacaactactttattttctcttgggtaaatacctaggagttaaatggcagaactggataattaacttttaaagaaactgtcagattattttccagactgattctatcttacattcccacatcagtgtgtgagagttgcagcttctttaaatcctcactgacacttggtatggttggttttttcaattttatccattctaatagtcatgtagtggtgtttcattgtggttttaatttgcatttttcctaattgctcttctatgcttatctgccatccgtatattatctttggtaaactgtcccaatcttttgcccctttttgaattttgaaatttcttatatgctttggatacaagttccttatggacatatactttgaaagtattttctctcagtttgtggcttgccatttaatttatttaacaatgtcttttaaaaagtaaatttaaatgaagttcagtttttctgtttgttctttatagatcctgcttttgatattttgactaaagaaaaaaaaaaacaagcttttaaagaatttaagttagttttatccagaagtcttactgagagctatagactgactgaggactacagcctgggaggagtctttcagaaaggttctgttggccaggagtggtggctcacgcctgtaatcccagcactttgggaggccgaggtgggcggatcacctgaggtcaggagtttgagaccagcctgaccaacatggagaaaccccatctctactaaaaatacaaatggcacatacctgtaatcccagctacttgggaggctgaggcaggagaattgctcgaacctgggaggcggaggttgcagtgagccaagatcgtgccattgcactccagcctgggcaacaagagtgaaactgtcccaaaaaacaacaacaacaacaacaacaacaacaacaacaacaacaacaamacaaaccagaaagattctatcagactgctccaaaatagtgtttcagctcacagtttatatacaggttcagtgcatataaaatcacatcraagtttgggtgcaagagtctatctagttatagattacagaagtgtaatcactaaccctgtcaggtgttctcttatgtgtaggaaaaggcaaggactagggccatttatcttttaaggaatacagtgactcaggcaagagctggagggtgggaggccctgttctctattctgttttgtcttcaatgcacgtttctggagagctacacgttgtcacagagtcaggggctttgggaaagtatgttgacragcagaaatgagcaaatatgtcttcttacatttgttactttggctcacaggtatcttatctaaggaaactttgcttacgcaaagtacacaatgattttctcttatgttttcctctagaagttttatggttctaagttttatatttaggtttatgacccttttcagttaatttttgtatatggtatgaggtatgaatcagttggttttttcagtttatatttttgcttatggatatctaatagttccaccatgattttaaaattgtgacttcatatttaaaagtggagaaaakgctatactacactgtcttaatcatttattatacttttaatgtctctgacagggacaatagtaatgacccctctttcaattttattattagtcatttatatcttctcaccttttttctcgactaatctggttagagcgttagcaattgtattgatgttcttaaagaaacatcttttggatttgttttatagtttctatataattatctactattttattttttcctgcttactttgattttaattaaattatccttttctagtttttgatggtaaaagatgaggtcatttatttgagacttttcttcttttctattataggtgtttaatgctatggttttcctctttggcactggtttagtgacatcccacaaattttgatatgttttgttktcctcttcatttarttcaaaatattcaattcaaaagattttttaattacctcctttgacttctttgatttataaggtatatacagatacattacttagtttccagcatttgatgattttccagagatcattctgttattgataatttaagtgtggtcagagaacagactttttatgactcaaattcttttacatttattgagacttgttttatggcccagaatatggtctatattggtacagatttcttttgttcttgagaggaatgtgtagtctggtgttgggttgagtcttttcaaaatgtcaaattagatcaagttgactacttgtattgttcatgtctcttatatccttactgattttttctgttctgtcaattaatgactgaggcatatttatctctggctatatttgtggatttgtttatttatccagttactcgtttttacttcgtatgtttcaaaaatctgtaattagatgcatacacttttaggattgttatgtcatcttgataaagagactctatcattatgaaataacctttttttttaaaatccctgctaatatgttttgctctaaaatctactctgttagattttaatattgatacttcagctttgttttgtttagtgttagctgggtatttcgtttttttatccttttacttttaatctatttgtgtcttcatgtttaaagtatggttcatgtagggagcatatagttgtgtcttgctcttttatccagtctcataatctatgccttttaattgagttgtttagaccacttacatttaatgagtgtatatatatgtgttttcatatggttatgtttaaatctatcatcttgcttttgtctattgtcacatttgttctattttttggatttggtatactttatgatttcattttatcttcttgttggattgttagccataattctttattttatttttagtggttgattcagtgtgtgcagtaggctttaatttattgtaggcaacttttaagtgacatcgtacccctttatgtatagtacaagaacctcacaacaatacagtatacttactttactcccctgctttttaaaacttttgtaataaactctattgttattttcattatctttttagaacaactttattgaggtataatttaataccataaaagccagccatttaaaattcaatagtttttgatatattaagagttctgcagcagtggcatgtgcctgtattcccagctattcaggaggcagagacaggatcacttgagcacaggagtttaaggccagcctgggcaacagagccagtccttgtctccagatagatagatagataatgtgcaatcatcactccaatcaagctcagaaaatgtttatcattccaagagaaacctcatatttgttttcaatcactccctatttatcctcttccaaactcctgaaaaacacgaatctactttctttctcatagatttacctatcttggacatttcatgtaaacaggcttatrgatttgtggccttttttgattggcttttcacttagaaaaaaatgcacaatactgcatgttgtagtatgtatctttctttctttttttgttgctgctcaataatattccattgtttaaaaataccatatttaactttatcctttcaacagttgatagacatttggattatttctactttttgatgattctgtaatgcttctatgaatattcttggagaagtttttgtgtggatatatattttcagttcttttgggcatatacttaggagtggaattgctggatcatatgaaaatgctatttaatattttgaggaactaccagattttcacagtggctgcaccttttatattcccaccagcaaygtataagggttccaatttctccacattcttaaccaacacttgttattatgtcttttaaattatagccatcctagtagttatgaagtgtgaatttggcttttgtttccctaatggctaaaggatatccagtgtcttttcatattcttgttagccatttgtctgttttcttagaaaaatatctattcagatatttaatcattttaaaattagcttgtctcttcattattgaattgcaggagttctttattctggatacaagtcccttatgatttgcaaatatttttctttctatgagttgttttcaattatatttttcagatacttatataataaaatggtttttatatttatccatgttattactattaatatttttggtatccttcatttctttatgaggatccatattttcatgtggtataattttctttctgtctgatgaacttctttttaacatttcttatggtccaacgtctgcttatgatgaattctttcaccttttgtatgtttgaaaatgtttttattttactttcacctctgaacattttttaatgtgtataaagttctagattgatagttcccccacttcccattattttaaagatgttgatcacctgtctttttgcttggattgtttctgatgagaaatctgctgtcattcttatccttgttcctctctaggtgtctttttttttctttaatccagtaactttaaagattttattgttatggttttgtaaatttgattgtgcatttttctttgtttcctgtgctcatgcttcattgagcttgttgagtctgtgggtttatagtgtttatttttagccttgttttttcactctccctttttgctttggggactccagttacgtgtacagttgacccacgaacaatgcagatccatttatatgcatatttttttccaaccaaatgcagatcagaaatatagtattcatggtatgcgaaccccacaggtatggagggccaactttatatatatatatatatatacatgtaggttccacagggctgtctgtggtgtaactgcccaatgggttctccttacctactccccaggtggaactgatttatcaagacaggagacttgcaatagcgaaagagtttaattcatgtagagccagctgaatgggtgactggagttttattactcaaatcagtctccccccaaatttggagactgaagtttttaaagaataatttcgtgrgtagggggccagggagtagggagtgttattggtggcactggagatgaaattattgggagttgaaatattatataaacatatatattatataaacatatgtattatacaattgaatataatacctattatatatgcaatatattatatagaataaacataataattgaatagatatataatagttgaattgcatgtaaatgtagttttaataacaaggttgccaagtactgtattactggatgcttacattgttcctaaaattatcctatcatacatgatattgcattaagcatccttgtagcaaattctttgtcctttatatttttcccatagtataaattcctagtggtggagttacatgccttctgattcagcacactttttaggatcttgatggaaaccatgcatatacacacatttccctaatattagcattccagaaaggttacaacagtttcacctataccagaaatacatttgagcgcctattttcctactttgtatacaaacacatcagaaaaccatctttcaaggataactttcttatgttgaggcagttttaaatcacaatcattcaagcactcagtatygattttgattcattctcccaaaggtgcttgaattttaagctacttgaaaccttaaataatggaagatgtctctgttaagagaactctctgctgttgaacactgttattcagggctgaatcactttacttaccacagccacagacttctatattctgactagctatttcgacactttgtttccacccccattggtctcttttcttccctaattttcttcccttcacttcatatattcacattccttctattttaggccatttgggaattactttttttttttagaatagttaactttttaaatttttgttttatttttaatttttgtggagacagagtttcactatattgccctggctggtctcaaactcctgggctcaagcaatcctccggccttggcctctcaaagtgctggaattacaggyatgagccaccatacttggctgaaaattacttctcatgttagaaacatgcacttactcttagaatgaaatatttttcaagactcatctgtggttggaagagtctagcctgcccgaagcttggttatagaggttgtaattgtccttgttctgaaaactacggactgaaaacaccccagcttggcacagtggcgccctcagtagaaatgtatccaccctatagggtgcttctcctgtaagtggaaatcctaattcaaatttatatctgcattgctctaggtccctatgcaaatggctgagggtcatggcatgcacacacaaagaagatcaagagtttagatgactctggaaagaaacagggcagaatgaagtctgtctcttacccagagtagagttctacttttcaagaggatttttttcagtcttctttgtggaatcctcctcatttccccttaaaatgtagatctcattccttctcttcttgctctctgtcttcatgagtgatcacactcccttgagctcaattttctccaactcagaaatctgtagttccaggcctttcctgatttactacttctaagtagagattttctcccattttctaagcattgtaacacaaactagcttgaccttgaggctaaacagtttggccaatatatcctttgccttcatagtgacacttattctaagatagtaatctccataatttgaattttacaattcttggttattttggtaagtgtcaggatagcattcctctccatcaggaccacttctaaagtgaaaactatacagctgggaatacagtctttgaaattaagacrgtgtttacttatataagttttggccagtttctccagcttctagaatacctgacctggcccatcatgacctgataaaatacatgtaaaaaggcgcaattgtgttaattgtgtttctctctctgcagtcagtgtgcgcaggatgggctagttgtatttcttccttggaatgcgttagctctgtgccctgtagaaaaaatgatagacttttagaccaatttgaaaataaaagatctaattgaaaagctggagaagcaaatgaaaagactgatcttatttgtggaaaaggatttatgaacatgaaatatattgtatcctgtgagtacactgaagcaagatcttagggctgacactttgaggaagagaggaaagtagccacagagagaggaaagcagcctgtagccacaggtggcgatggtattttaaaacaaaacataaggtagtcatttggtttctcaaatgcatttctgatttctttgttctgaatctgcatgtgaagcaaatgaacccatagcctccttcatcccagctgaaccatttgcttcactgtcagtgaagggggtagagtcagtggtagggataagtaacccagataaaaagtttagcatggccatgtctctgtcatcctgttttcccctttcctttttctttttgattctttaaaacggaaattctgattttatcaactttagaaatgaaacagtattgattggctcctttctcaaaaggtgaagaatgttctcctttttcttgtgattttctggagttttcatcttagcttattagttacacgtatttcaactgtatagctttttttttttcctattagttaaaactgcattcttttttttttgtcaccgttactatcacaggtattctgtgcttatctggattgacaagctgctcttgccaaaggtttcctgagcacattattttgatttgtcatatgagtagttgtattatgtgtttgaacaaatttttcagggagaaatatatcttaattataccatatgatccagcaatctcactgctaagtatatacccaaaagaaagaaaatcagcatattgaagaggtatcttcactctcatgtttattgcagcactgttcacaatagccaagatttggaagcagcctaagtgtccattaacagaaaaatggataaagaaaatgtggtacttatacacaatggagtattattcagccagaaaaggaataagatcttgtcatttgcaacaacatggatggaactggaggtcactgtgttaagtgaagtaagctagtcacagataaactttgcatgttcttatttgtaggaactaaaaaaattaattgaacatatggagacagagaatagaaggatagttacgaggggctaggaaggtgggttggttaatgggtacagaaatatagttaaatagaatgaataagatctagtatttggtagcataacagggtaaatttattgtacattttataatagttaaaagagtatagttggattattggattgtttgtaacacaaagaaaggataagtgcttgaggtgatgcgtacccatttaccatgatgtgactattacatattgcatgcctgcatcagaatatcccatataccccacaaatatatacacctactatgtacccacaaaaattaaaaataaaaatattaaaagtggcttgtttttgttattgcaggtaaacaaaggcttgattggctgtagaatttttgagtcgttccatatttctgacaaaatcttgaaatttattccttcatcttatttgttggggtgaggttaatggctgtgtccagcccatttttttcccattatgatttgatttattttccccatttgatttttttaatgggatttcttttaatttttaaagcttattaacttaaacctgttttkcacttatcatttacttcatagttttcctggaatttgtcacacttttttaaattatggtaaaatacacataacataaaatttaccctcttaaccatttaaatgtacagttcagtagtgttaagtatattcagactgttgtgcaaccaatctccagaactcttttcgtcttgtaaaactgaaaccccgtacccattacacagcaatttctcattcatccctctcccccagtccctggcaagtactactgtactttgtctctattaatttgactattagctaccttatatatgtggagtatttgtccttttttgactggcttatttcacttagcataatgtcttcagggttcatccatgtcatagcatatgccagaatatccttttgaaggctggatgataagccattgtatgtatataccaatttagtttatgtctgttcatctgttgttgaaaacttgggttgcttctacctcttggctcttgtagatagtgctgctacaaacatgggtatacaaatatctctttgaaagatcattaacagttattttggatatatacccagaggtgggattgctaaatcatatggtaatcctattttaatttttttgaggaacctctatactgttttccatagtgattgtaccatttttggtcccaccagcagtgctgggttccagtttgttcacatccttgctaatacttcttttctttttttgataatggctatcttaatgggtgtcagatgttatcttactattttgatttgcatttgcattttactgatgattagtgatgttgagcatctcttcatgtttggccgtgtgtgtgtgtgtgtgtgtgtgtgtgtgtgtgtgtatgtgtatatacatttttgtagaagtgtctactcaagtcttttgcccaatttttaagttgtttgttggtttgttgtttttgattttgagttgtaggagttaggaaagtttacttttattgctaagtaacttctgttccacttatttttgtcaagtatgccgattatgttgaatctttatgtcctgcgatttatatccataatttctttttaaatttttttatttttattttttattattatactttaagttctggggtacatgtgcacaacatgcaggtttgttacataagtatacatgtgccatgttggtttgctgcatccatcaactcgtcatttacattaggtatttctcctaatgctatccctcccctagtccatcaccccctgacaggccccagtgtgtgatgttcccctccctgtgtccatgtgttcttattgttcaactcccacttatgagtgagaatatgtggtgtttggttttctcttcttgtgttactttgctgagaatgatggtttccagtttcatccatgtccctgaaaaggacataaactcatccatttttatggctgcatagtattccatggtgtatatgtaccacattttctttattcagtctatcatttgatgkgcatttgggttggttccaagtctttgctattgtgaacaatgctgcagtaaacatatgtgtgtatgtgtctttatagtagaatgatttataatcttttaggtgtatacccagtaatgggatggctgagtcaaatggtatttctagttctaratccttgaggagttgccacactgtgttccacaatggttgaactaatttacactcctaccaacactgtaaaagcattcctattttccccacatcctctccagcatctgttgattcctgactttttaatgctcgccattctaaatgatgtgagatggtatctcattgtggttttgatttgcatttctstaacgagcagtgatgatgaacattttttcataagtttgttggctgcataaatgtcttcttttgagaagtgtctgttcatatcctttgcctactttttgatgaggttgttttcttcttgtaaatttgtttatttgtagattctgtatgtccataatttctaattaatctagtaaattccattattgtaagcacatgtactttttcccaagccagacttccatggcaccaacttggttttctgcagtggcacttctgtcttttgtagttttaaatttttagtttctgcagtgatttttttttatttccttaaaaaattttaaaatcaaacttgtaaatgtttataatttaaaaatgtataggtagatactttatttggcaaacaatgttagctatcacttttaccatgttcactatattgttcacagtatgataagtattactccaggtgtcttaggtacattaatcaattcaattcttatagtcatatgtggcagccttactattattatacccattttacagaggagaaatctgaggcaaggagacatgacataacctgcccaaggtcatactggcaggacaaggatttgaacctaggcagttggattccctagcgtactgtacttgtaactactatgcagcactgcctctcttcctccttttcttaaaaraagaaatgtatgtgctttatttgaattctgactcaaccaaccaaactgttaaaagttataagaaaatcaggggattgtgaacttaccgaatatttgatgatatcaagtacctctgattaattttttaactgtgatgatggtaaggtagtttccttataaaagagttcttttaaggacaaaacagctaaatatgtaaacataaagttacttacagcatatgtattatgctgagttatttacagaagaaattaaatgatgcttgggatttgttcctctatattatctttaaatatattcattttaattgatatacatttgtacatatttatgggatacagtgtgatattttgatacatgtatatacaatgtgtaatgatcaaattaaggcaattaacatatccatcacctcaaaccttcatcatttctttatacgggtaacagtcaaagtcctctcttctagctatttgaaaaaatacaataaattgttgtttgctataagtcactcttcagatctatagaacactagaacttatttttgctatctaggtataactttgtacatccattaaccaaactctccctatccctccctgtcccctaggcttcctggtatctagtaagcactatcctactctctacttctgtgggatcaacttttttagctcccacataggagcgagaacattgcagtatttatctttctgtgcctgacttacttcgcttaacatgcagtcctccaggctcacccgtgttgctgcaaatgacaggatgtatgtaatttaaagtgtcaaatagctctgaggcttgccaggaaagaggagtccttgcttgcttcctacaattttaccttccccagagctaccactttcagttgttttggcagcctcatttgatatttgcatttaatctgtaagattttttttaacttctttttgaaaatttttaaaattgtgaatgatatgttttgaaatatgtgctatgtggaattctaaggtttttatttctttttatcttactagtttggaatatttatagatgtaccatgtgcaaagtgtaccattcacatactcccatcctgaacctccttttcttagtatagttaggtcatgattttgactaggccattattcagtgttaataggatgatgaccttgttaatgctgttcatacctgagccatgtagaattctatgaatcctttycctcttctgcaaattttttgttctatttaaactaattgttcttttgatgtttgcttagttttctatgtgctttttactcattcagtcctaaatgctcttggttatccaaatctcctcttgatatactacttcttgagtctttttgcttatcacccaaggatttcccttcacaattatgccaggaattcctttttttctccctcttgtattggactcctgtttcctgtatcacatgcctgtctttttcttagtttcctccctgttttgcagaagaacatctgccaatagaattctaggttgtcaactgccttcctcattgcttcattgtcttctagctttcagggttgctgttgaaaagtccagagactttctgattcctaatcytttgcttatgagcttccctacctgctttttgatattttataggacctttttaatatccttacagttaaaaaaacacaactcatgatgacagatgctgtgtttaatgtgggcatattgaaatcaaatgaaatgggcaggtaggcactcagtgggcccttacagtctacacagttatgaccttacgttttaggaaatattttgagttagtcatttgacttcactccaccccatttcctttactcttttattctggaattctatttggctattagacctgctggactcattttgtagccttctcatttttactgttctagtcttctttacttttttttttttaactctacattttgggcacattccttaaagttatattccaatctgtctactgaattttttttgaattcttaaaaattgacatataaaattataagtatttatcatgcacaatatgatgttttgagtatatatatattgtggaatggttaagtctagctaattaacaaatgcattacctcacatagccaccatttgtttgcggtaagaacagttaacatccactcccttggcattttccaagaataccaygtatcatcattatctatagtcactgtcctacacgatrgatctgaccttattcctcctaactgcaatagatctcctgtctaactgtaaatatgtatcctttgatcaacatcttcccaactccctctccccacaaccaccccagcctttggtaaccaccactttgctctctayttctgtgggaaaaacttttttagattttgaattaccactttttaagcatcctgtttttgtttgaataagtgcaatatattcttctcgatgttactattgttaaacctattcatctgctcagattccagagagaaaaatctttccgtctcaggccttagatgatgtaagactggcttcagatgctatttagctctgataggcggaagagataataagaaagaagacaagcttcagctctgaactgcctgtatctcatcttgttcctccaggtttgggcttcaggaatttcttctattttgtttatatcagactatagggctctctgaagaatgatacatagtttgaaaaatttccccattttatctaaattgttgtatatctgtaatagttttctaaagtttttagaataaatttgtcctttccaggtttcagcattgatggtttcttctttcctyctttattgcttttcattcatctattctgttttggagacgaaggctttaaaatctttacccacgtagcttcccccagctacctctgagaagtctgttttatcttttgcatcactaattttattttttgctttttaaaaatattctactttctgcttcattggttgcttttattcaagttcataattcagattttcttttctggttagcgcagactcttttctggtctcatatttctttctatggctacctgctctatgtgcaaagattctactatgtcccctggaattttaagaacatgagctagaaattttctgttaatagagttttctcttttatatagtatatctatttcttaagtaaatatttgctctgattctagaatcttccccttttctgaaccacaatgtgttctatttgcctggtggatttagatttttctcctttgcttatccttagggaagtcaatgcatattcagtattgggtattgccttgttttctttccttctttccttctttccttccttccttccttccttccttccttccttccttccttccttccttccttccttccttccctccttccttccctccctccctcccgccctccctccctccttccttccttccttccttctttccttctgttttaaaattttactttaagttccgggatacatgtgcagaacatgcagtttcttacataggtatacatgtgccatggtggtttgatgcacctatcaactcgtcatctaggttttaagccccgcgtgcattagtaaccctgtgttctttcaagaaacttgtatgagtcactatttgactcaagtccagacaaaggaaaaaggttacatttgtagtagattaatttaccaattatgaattcatattcctgtgaggcctgggaaaagagccagcatcagctccagaagtaatcaaagggaagtttgcctcaaaccaaagactttgttttaggtatttggtgtggcactcagtaattagcaaggtcattgtcacttggcatggctgcccttgccaggagccagctgggagtgtctttttcccaygtgttttctgtggtagtcatcatggccacctgtcaaccagaagtaaatgcagccagaggttacttgcttggctggcctctgaagccaggagcccttttaaaggagttagtgtgttttaaatgtaccccaagtcttcctgggcttagttccctcagcccccatcgctctaaactaggggtatcattatgggtttagtggattctcatttgcttattttctggttgtgcagttgcagtttcacatgaagaggatatcgtgttttagtccttttgtcaacctcccatgttgattctttcaagtatatatttctgaacgtttaagatctatttatagtttccagggctgattcaggatattcctctgttataatcaactggtcatttctttggtaatctggcacaaagaaataagcttatagctttcttatttggaaattgtattttatatatgtgatttgaatcataggggggatattgaggtaatttagacccagtgattgtaaaggaatggatgaatgatccaataaataaatagatgacaaagctcatcttttgcaggtgagaggcattagaagtaattttacggttttgagaagagaaatatagatgagaagagatgcctaggagaatagaaaatggagacaactaggaaagaagagaagaggcagcagtaatgctccaagggcagttggagagcctgatgtcagctgggcaaacccacattgcttcatggttttctgtggctagaacacagttttgaagctcaagcaaaggaaatggagagttaggttggtggcaggttggaagagttgcagaacaggtatccaagtacttggaagagttcagaggggtgtatttcttagtctcactctgttgcccaggctggagtgcagtggtgcaatctcggctcactgcaacttctgcctcccaggttcaagcagctctctgcctcagcctcctgagtagctgggattacaggcgcctgccgccacgcctggctaaatttttttttttttttttttgtatttttagtagasacggggtttcaccatcttggccaggctggtcttgaactcctgacctcatgatccacccacatcggcgtctcaaaatgctaggattacagacgtgaaccaccacacccagccagggatgtatttctttaaaaattattgtgcaactctctagttgacagtctggggctctggtaaggcgggggttcatctgtcaaagtgagccagcttactcagctagatactgtatggcatgattacttagggtaatgtmttttttgtcttgtttagttcccccatgatttgtgcagttttgtaaataagttgagaagtaaatagatttcatgatataattttaagacttcactcccaagggaaaactgatttatacctttgaagttatgtcatttagcccttgtatttggcaaagtaagcatacactattttataaagcgttcttgtaatgtgtgaataggttcaacaaaattagacgtgtcgcatgttttaggagaaggcagttaattttctgtcttattttcttcttgaaaatgtgaaactaacaatctgtcatgtttattaggcatctcaaggaaatgaaacatccaaatgagggttaaatggttaaaattttatatagatgagaagagcacaaggttctctgtctcagggttactctgcaggtcatctgactttcatcctactttctccattttttatctgacatttttgcttaaagattccatgtgctttccatctctttttaatctttgatcacatggaatattggcctatggaaagagtatgaatcttagcataggccctggttcagacctcagctctttcatttcctgactgtgtgactgtgggtatgttgcataacctcacaatacctttcaaagcctcagatgtctcctctgtaaaataactgaatagtatctgcctcaaactgttggggaaatgactgctccaaagctcagcatccagtggcctttcatgaaatcccagtctygcatctttccctctgctgttgttagtartaacgycatatgacatatttgtttggtggatctcatccatttctatttcgctttccttactctaagctaggtgcctctatttaccttttaggcaactctctatattctgaatattgaaaatattttaaggttatattgcttaatgacatagcttggtgaaatgatattggacctgagcatatagtatgcgtccttaagaatggaatcttatgtgcttgattttttgctttttagttgtattattgatatattcatttatgtcacatagarcaagataatgtgaattataaatacataagagggagaaaggaaaaatgaaagtaggagtgggcaaaaaataatgccaggaataataartacatgagaaggagaaaggaaaaatgaaagtaggagtgagcaaaaaatagtgccaggaataagttcagtgtaaaacagtgcaccttggggttcctgtaattttcttgggtaggtttggcactctagcagtcatcttgaaaaaagaaaggtcctgtatacatatgcttttctcctgggttgtttatttactttcacagtgtgataaacaagtctcatttgttcctaaaactgggactaaggagaatatcagtactgtcacagggcagctgtggaattcggtgttgaatgtcatgacaagataacttgagaactttactacttatttgtgaatgaaaataattgctgtaatgggagaagaaaataggaaggctctacagttctaagcagccagaacctaaagtgattgaaactgtagtatcaaggatgctgcacaaaaatgtagcaattaaaaatttaagcttatagaagttgctgtcaaacctagattatttcttagaaaagcagcacttctgagctcctcatttgcccagtatccctgagctaatatagggtagcaccaagggatgtgggggacaaaggacttggattaaatgtccaactccacagttcctgctgtgcaagacttggatcttgtgacatctggttcattacttttactattatgaaaagtatcatttcccaatagtttaaaaagtgttcaggtatcatcttgcatgttggtgaaactaggaagtatatttacagacaaaagctccttaaaggcaaggttggcttagccttactttttttttttgagacggagtcttgctctgttgcccaggctggagtgcagtggcacgatctcggctcactgcaacctccgcctcctgggttctagtgattctcctgcctcagcctcctgagtaggtgtgtgccaccacgcccagctaatttttatattttaagtagagatggggtttcamcatgttggtcaggctggtctcaaattcctgacctctaatgatctgcccccactggcctcccaaagttttgagattacaggcctgagctgctgtgcccagccaataacgtcttttgaataaaagaaaagatattgttagggagtatgaacatcaccagaaaatgaaaatgtttcttaaaaataaacgaatttttaaaaattattttcttaaaatgaaaaatttttttcttctggactaaattgcaatgtggaaagagtcacatcagcctttggacagaactagggctgtgatttactacagggaagttagcatctttctgagttttcttaatgaacacgtgaataagagatttggttatactttgtgcttatttagcatcctctctttgaggatgtcaaaaggattttagaaatgttctctttctcacacaggtggacgtctgatttatgaagctccccatccacctatctgagtacctgacttctcaggactgacacctacagcatcaggtatcttgcctttctttagtcttaaaagcggtaactaagttccttgaggagatataggcagggaacacattaacttcgttacgtttcatataggcctgggaaccggagttgctgctgtagtcctggttctaccattaaatgtgtgactctagtcccttttcttctctaagcctcaattttttcttctgcaaataggtggggttggacggggtgctatctaatcacttgacggtattatggtagtctacytttatccgaagcttcactttccacagtttcagttacctgcagtcaaacttggtccaaaaatattaaatgaaaaatttcagaaacaaacaattcacaagttgtaaattgcacaccgttctgaatagtgtgggtgaaatctcatactgtccatgtgatttgtccctttgtcctgcgattccacactgtgtgtgctacctgtacattagtcactcagtagctgtctctgttatatacagggttgggtactattcacagtttctttttctttttctttttcttttttttgagaaggagtctctctgtgtcgcccaggctggagtgcagtggtgccatcttggatcactgcaacctctacctcccaggttcaaacaattctcctgcctcagcctcctgagtagctaggattacaggcatgttctaccacgcctggctaatttttgtatttttagtagagatggggttttgccatgttggccaggctggtctcaaactcctgacctcaggtaatccttccccctcggcttcccaaagagctgagattataggcgtgagccactgcacctgacccactatccagtttcaagtatccactggggggcttagaatccactcctcagataagtgggggtggttactgcattctctttgccctctatgtaagccgtcagctctccactgtggattattcaattcctttattatttaatggcaggatggcttttcccccgactcaccctcctcagctctgcaacttgaaactgtcttcccaaaacatctagctgggatgttggattcaaacctatgaaaattcctcaacttaagagtatttggacagatagcacagaagtcgtggcttttagaccttagcttttccctacyggctttctgtttgcattaagctrgtatttgacacttgatgtctagggattcttacctcctttggccaatggtacttcacacccatatgctagtccttttatgctaaatgtgggttttcctgttgttttccaggtacacagcttctcctagcatgacttcgatctgatcagcaaacaagaaaatttgtctcccgtagttctggggcgtgttcaccacctacaaccacagagctgtcatggctgccatctctacttccatccctgtaatttcacagccccaggtaagggcttcaaactagcagaggtctgaggtaatcgtaagtttgtcaaatatttaaactgggtttcaggaagtgtatttgactctagggatcatgtatatctctctcgctatcatttggtgtgtattcgaataatggtgcttttgtgagtgaggtgccatttcgttcaggaagcagctggaacaatgaacaagtgattttagtgaactggcctctgttcataggaggccttggttttcagtgcttaggatgtctgacattataggcatcaaactctaaatcaaagtaagtcagtagtaaaccctgctgcttttcctctcttggcttttttgtgggccggggggtggggtggggtttaatgaaatatatcagaatggatctaattttataacaagttttctgagggctgtcttgttgtcctcctcctatacttactcttttgccttgatctgttctaggaactttgaaacaaaatgcaattccagaaacttctgagcagcaatcgtatgagttatttttttctgtccagtgaagagcagtaatacggcagggacatggtctttgttcagatgattttacagcctgatttaatcaggcattggctggactctttcagattcaccaggcagcagggtacaatgtggaaacagactttggagtcataaggccacagttcacatccctgctcctctgattgcaggataaagagccctagtcatgctagcttctctcagcttcagtttcctctcatgtaatcattcctcacatgatggttatatggataaaatgatggttcatatacatgaggcatacagaggtgctcagcaagtgtagtttcccatttactcttcatttatcttctttctatagtgtgacctcctttcttatttgtgacaatcattttttggccaactttatttttatttatttatttttttgagagagagccttgctctgttgcccaggctggagtgtagtggcatgatcttggttcactgcaatctccacctcctgggttcaagcgattctcctgtctcagcttcctgagtagctgagattacaggcgcccgccaccacgcccagctaatttttgtattttagtagagatggggtttcaccatgttggtcaggctggtcttgaactcttgacctcaaatgatccacctgccttggcctcccaaagtgctgggattacaagcctgagccactgtgcccggcctcgggcaactttgaagaaaaaagcatactttcaagaaagagccatactgattgaaatttgaacttgatacagaacgttgttccacactgtttttttcagtatgattttgcaggctattcaattttgtatgtattttaagtaggggtttgtgtgtttgtgagagaaggagagaaggaggagagggaaaaaggagaacaaggggcatttttccctcatatagtatagtgttttctcctcaacaccatttgggatgtcatcattgttatcaaccttgggattttatcatatgaataaagccctttattcatatcatatgaataaagaataaagtactaaggcctttagtattattttccagaatgtttagtgttaccatcgtcatacgcattcctctttctggtaagtggaccattgtcctttcaacacttcatttactttgggtgtttggtttcccttatcttcaatagacttttttggtgtctgagagacttggagaatgggcaaagagatttagtgcctgttacctgaggtcaccatttcaaagtccactgcagctgttcccatgtaatgactcttcttagtcctttcgtgaagtgagttaggctagtgcgggttttctagacagggcatttccacatcccggtttgctgctgtcatctttcagcatttccaacagcatcttcttatctatatatcttctctgttacacaagctcctatcagctggtgaggaatagaaatacctctaaatgactcatttaattaaaatgtttaacactgcccaaaggagaaagaggttctatttcatacaatcactgggggaaatgtgtactctcgtaaattctctgtgggaaagtaaattggtacagtcactctggagggtaattcaacagtatctattaaaaktatacacttctgcacatgccctgctcctgtcttggaatctacattagaaaaccactcacacrtgagcccaaggagtgtataaggaatgtataaagatattcattgaagcattggttgcaaaccaagaagtacaaaattttgtgaatatccaatagtagaaagacttaatgaattcaggaatgtggacatgattgaaatactattcagtcattttatttatttcttttttttttttctgagacagagtctcattctrttgcccaggctggagtgtagtggcacgatcttgtctcactgcaacctccaccttctgggttccagcaattctcctgcctcagcctcccaagtagctaggattataggtgtgtgcctccatgcctggttaatttctgtatttttagtagagacggggtttcaccatgttgtccaggctggtctcaaactcctgacctcaggtgatctgcccatcttggcctcccaaagttctgggattacagccatgagccactgcgcccgaccactattcagtagttttaaaatgaggatgtctacacagctatatattactccaagatatcgtatggaggaaaaagaaagcaagacgcaaaatagtacttatgggaagataccaytaaaattctaaaacaagactgtgtatttttagggagaagtatatggtacattaatggaaatggataatgaaagtcctagaacatacattcttaacatagttatattgccccaagaggacaaaaattgggttttgggagatgaaaaaaatccctccagarcttatacctctatccaacaaaatcttattccttagtatttagttttttctcattagaaaaaatttaaatgtaattaatttttctccttaaggatcactaatgagaaaaaaatatggccaagaaacactggtttcttgagggaggcacataggctcaccagtcaccctgcttcaatttactaattacctgagcctgaggggaaggtatccaccctcttagtgcctctatttccttacccacggaatgagcatagcattaatgaagccaacctgatagggttattttaaggcggaaatgaaataatttctataaagctcagaatagtgcctggcacatattctgggcacatattgcccagtgcatattagcaagcattgttattattgctcagcaagccttgtggcagggctgggggatacaagaataaataagagaaataagttttgccctgccagagtttacagatatagtgggagatacacagataaaacaaaaagttacaacgctttgtcacccatgcaggaatgcacaaatacaggaagtatgggtgctctgggaggaaagtggagacccaagaaaagatttagaggatcagggaaggcttcttgaaggaagaccactaggctgaggacaaattaatatgagttattttggtaaaggagaagaaaaagcataggtgaatgtcaagtgtcccaaggtatgtgtgtgtgagagagagagagagagagagggagcaaagcatttagaattttgttttggatggttgcactacagtggggcatgagattgtaaacagtgatgtccctagagccacctataccaactcacagaagcagattgttaaattttcaggaatttcgcgagccaattgacttcatgccagcagcttgaaatcagccacatggaatagttatactgcagaaatcggcaagtgctagaattagcataaatgggttaggttataaagttggagattttacagggtctttcaaaccgtattaatgaatttaacattgatcttaaaagaagtctttgttagcttaatggtcccagcctttgaaatagacctgggttcaagttctgactttcgataatagtkttattgagcaagtttattaattaaccttaaccagggtagttgcattattctcaccgtattttgggaatagtggcagcctctgatggttggggaactaagcccacggggaaggagtcagctatacactgggacattaggtcatagagatagatagcttcttctggagagatgcagaccattgggtcacttggttcccaggatcctttggccaatgatgggcctcctaattatatgtcaattcctcacatgtaatttgtacagtgaaatttagtccaaggctgacttgcccttgccccgaagcttctactgatgtcttctctcttattatcagttttgcccaagttcaaagaaggtaaaaataatttagatatagcatcttcttaggcaagcataataagsagctcactcagtcaccttagcctggtattgtctggcacatcaacttgcwttcttttccagtgaattcagggaccttgtaaagataaatccacattcaagtgtgaaaggcctgaaaatccttttctaaggccaaaacaacaattttttagaaaaacttttggttttgtttgttactctattcattgggtaacaaagagcatttttctaatcaaggctgcctaatactacatataaacgaattaataygaacaaatagcttgtgattgtttcaaacaataatagggaagaaagcttgcattgtcacgcctgctgggattgctgtttagttagttgaaagatatgccttgttttttgaagtggggcaagtttgtattctctgctttacccctgccttgactctgagacagatttttgttttctcatgctgagagagcacctagctcttacaaagctaggtgatgaatactaagacgaaactggactagcagcagcaagaagatgccgtgtttgtaaccgatttataattctgctggtccagacactgaaaaagagttttcttatccaaaggaaactcctgggatgtatttgcagacaggaacctgttcatcattaggttgagttaatgtgttcgtatcctgtggatattgggggcatggggatggggtaggaaaccaaacaaacttgcagctctccagagccattttctgtttctagcactgtgttaagcattaccctgtgcttgatcaggttactgtggatagaagttggattaaaagtttcattttcattgttcatgaaagagtcaatagttcagtaccagagtgagcagtttggcttctcttaaacctaggattatattagaggccagaataggtatctgaaaacctaaaagatattcaggtctcacacctgtgattccagtaaggcaagagtcttctttatcagtatttttcatggtgtatcattctgtctctcatttgttacatgaccattttgttattttttaattttcatttttatatttatttgaatttaaattattttattctaaaatattttactttaagttctgggatacatgtgcagaacatgcaggtttgttacataggtatacatgtgccatggtagtttgctgtacctatcaacccatcatctaggttggttttttttttttttttcttgagatggagtctcactctgttgcccaggctggagtgcaatgtcgtgatcttggctcgccacaacctctgcctcctgagttcaagcgattctcctgcctcagcctcytgagtagctgggactacaggcgtgtgccaccatgcctggctaatttttatatttttagtagagatggggtttcactatgttggccaggctggtcttgaactcctgacttagtgatccgcccaccttggcctgccaaagtgctgagattacaggtgtgagccagcatgcccggcccatcatctaggttttaagcccgcatacaataggtatttgttctaatgctctccctccccttttccccmactcccagacaggccctggtgtgtgatgttcccctccctgtgtccatgtgttctcattgttcatctcccacttatgagtgagaatatgtggtacttggttttctgttcctgtgttagtttgctgagaatgatggttttcagcttcatccatgtctctacaaaagatgtgaacttattcttttttatggctgcatagtattccatggtgtatatgtgccatatcttctttatccagtctgtcattgatgggcatctgggttggttccaagtctttgctattgtaaatatagtgctacaataaacatgcgtgtgcatgtgtcttcatagtagaaatgatttataatccttcgggtatatacccagtaatgggattgctgggtcagatggtatttctggttctacatccttgaggaatcaccacactgtcttccacaaaggttgaactagttcacattcccaccaacagtgtaaaggtgttcccatttctccacatcctcttcagcatctgttgtttcctgactttttaataatcatcattctaactggtgtgagatggtatctcattgtggttttgatttgcatttctctaatgaccaggaataatgagctttttttcatatgtttgttggacacataaatgtcttcttttgagaagtatccgttcatatccttcacccacattttgatggggttgttttttctcttaaatttgtttaagttccttgtagattctggatattagacctttgtcagatggatagattgcaaaatttttctcccattctgtaggttgcctgttcacaaccattttggttttaagtcaagaacataaagatattttgatccctccaagtgatttcctgtagctttcattgaagatgtgaatttgggtagattttcaatatcttagttaagagattgttcctccaattctcattcagtgttctgataaaaagtgattgcggctgggtgctgtggctcacacctataatcccagcactttgggaggttgagactggtggatcacctgtcagaagtttgagaccagcctggccaatatggtgaaaccccgtctctactgaaaatacaaaaatcagctgggtgtggtggcgtgcacctgtaatctcagctactcaggaggctgagacaggagaattgcttgaacccaggaggcaaatgttgcaggttgcagtgagccgagatcgcactactgcactccagcctaggtgaaacagtgagactctgtctcaaaaaaaaaaaaaaaaaaaaaaaaaaaagtgattggtgtctgtttgttgtcttttggaagacacttttttttggacatccttaccaataggtactctcaacaaaatatgtattttcaaaatctgtgttttaggttttatttctgttattagaaagtggattttttttttatcaaagcaactgaatttcacattaaatgggttttttttttgaggctgaaagattcgtctttttggatagaactttgtactatggcagttttcagacattcacaaaaataaaaataacaatctcaatatagccaacacctagattcagtaataacattttgacacagttgcttcacttgctccttttttgggggatgaagtattttargatccctagcattgtcatcttttaaaaaatccccttatgttaatatgcatatctaaaaaataatttgcttaaataaccacactgccatcatcacacttagcaaaagtataaataactccttaatatcacttgatactcaattcacattcaggtttcttcagttgcttttctaaaatgtgttcttgtagttggtgggttatttatttttattttttaaaaacattgattagatcagtttactcttctgcataaaatgattcaatgactcttaaggtttaaaaaggcaattccacttcctctctttattttctaagtgagaaaacagattgaaattataactagaatatttcacaactgaagaatacaaaaatgagacacacagaaggcttcagagtaagggaattcatacaatgtttgcaattattaaattatgagtctctgaaataagggattacagattatcttgacagtgctttctttcaaactaaaatgtgaacaattaattgcagtatgaagtatgtttccagtgccacacgataatttcgtctaacatagaattgagaaaaggtaatgcatgggcgtagacccgggtggattttggttcaaatctagactgttatacaccatagctgggggatcttcagtacataggtctttttcagctttattttttaaaatctctagaattcaaataacatacagtgtggtaacaagtttaaatggcaaaaataactgttaagtgctttgtatagtatcagccttttgatagatacctgacgtatgttagttctttcccttttccccatgattagtctggaagttcttttttttttaaattttrttattattacactttaagttttagggtacatgtgcacaatgtgcaggtttgttacatatgtatacatgtgccatgttggtgttctgcacccattaactcgtcatttaacattaggtaaattctggaagttctttacagggagaaagaggtaaccactacatatggtctgtgtatgtggtatgccagaagacccatcaaaggaaggccacgttggataaacactctatggaaaactccaacgtattgccaggaataaatgcatgtggagataaacattgagacttctgacttcatcttgaaccatgtttctattagaagttaaatttgttcccatattgcaatttaaattcatcttgtgcctccttttgtgtttataaactcagataaggtttgagaagagatattattttggaatctgaaagcccattttgaattttctattcataagatgaaattgtacaggggtacctagggtaaaccacataagacacctttcatgtttgtttatttttctttctaatacatcctttttaattggtttagtcttcaatggttaatggagctactcctttatctttcaaagtgggtctggctttttcccacttcttgcccattagggaactgtttgcccaatctcgttttcatacccctagattctccagctgtctttctttgaacttttgttgcagctttgctgtgaatacacactaaggtgggacagtggcctgctgtttttttccacctgagaaaatcatagagtccaggggatttctgtcttttaagatctgtaccttgccttaataagactgtcatttaaaaaaaatcaacctttccctgctgtgtgaaaatattaatactgccatttggtaattgcataacatcacttaagagctgcccttaagttaaacttatcccatttcatacatgattgtgttaggcaggctcaggccaggagaaaagcaaaagtgggttgatactttcttctcagcatcagagaatatgtttattagagggccatggagcatattagtttctgaaagcatagattagaaataaagcaactttcaatgattcagacaacctttagtagcaggaattccaatcttgaaggaagaagagtagggtgtgtgtgttggtcaactagttggctgatttcaaagtcagaatgtccagcaggtgatatcaaacatttgcacttagatgagtttccaccaccaagcataggaaggttttggagtggagcaggtgtaggccccagctctcagggctttgcctacttagaactctgtttagtattaccttaattgtggttgatcaggttactgcagtaacctggtaaagacagtggaggagaagacccaggaagcatcccagctcaatggcacaggtcatagtgcagggctcacctctgacatgmtggattgtgtagagatgactgatgggaacttaggaatgagctgtcatggtcagatgtagatcccacttatgtaagataggtcaagatggagagacttaaccatagatcattccactgtctcattcaaaactagctggaaaactagggcaacactgaagttacaggggggaattcaatgctatggcagtggaggaagaaaaggcaggagaaacaaggtggcaaatgattgtgaggattatagtcatcagttacaccatggtatttactctttcaaatgatgtatcacaaatatacatgatatggtttgactgtgttcccacccaaatcttatcctgaatcgtagctcccataatcctcatgttgtgggagggacctggtgggaggtaattgaatcaygggggtgggtttttcccatgctgttctcatgatagtaaataagtctcatgagatctgatggttttataaagggcagttcccctgtacacactctcttgcctgyggccatgtacgatgtgcctttgctcctccttcaccttcygccatgattgtgatgcctccccagacatgtggaactgtgagtccattaaacctctttttctttctttctttttttttttttttttttttttgagatagtctcgctctgtcacccaggctgaagtgcagtggcatgatcacagttcactgcaacctctgcctcccggtttcaagcgattctcstgtctcagcctcccaagtagctgggactacaagtgtgtgccactacacctggctaatttttatatttttagtaggatgggatttcaccatgttggccaggctggtcttgaactcctgacctcaggtgatccacccgtctcggcctcccaaagtgctgggattacaggtgtgagccaccgtgcctggccctaaacctcttttttttttaataagttacccagtgttgggtatttcttcatagcagtatgaaaatggactaatacatttactcataggagtcttaggaccacatttggctttttttttttttccccttaaaatggttataaatgaattgctctcagtatctaaaatattaagtgctgctttttaaaaattgtataagtttattgctgtctcttagctcatcacagtaaaaacatagtttatagagataagctgttttgtaataaaaaaaggacaataatggaaggtagtagaagataataaaaactaaaatagatacaaaattccattttaaaaattgaaatggaacaagtttataaggaaatatattgttattagcctttcagcaaaatggcctaatggaaaataatttttcatttttgtcagtatgaattattacattgttttgacctgtcagttcaagtaaggctgcattttagagctggcatttggtttatgaagtttcaagtcttctgggttacctgattaaaagttgcaggagaatagatgtcacagaaatagagttctcagtgttcaacatataaaaggtgatctttttctctttgttttgtggatgagtaaattaacattccctcccatttcttcctctctctcttaatggctcagactgaattcaatttctttctttccttttttaaaaaaaattaagcaaaatgaaatgcttacagggagttataatgcaataacatagccattacccagctttgtaaaatgttaacatttcgatgtaatttcttcaagatcttttgggacttaatacataaaacaagtcagtaattacagataaagttggagcccttttactccttcctaattccattagcctcctctttgcccagrccattaattgatacttatcgtctctctgcatgtgcttgtgaatgtatacatatgtgagaaaaacataaaaaatayatagtaggcttctgcaggtttatttattgatacataatatttgtacatgtttacagggtacatgtgatattttattacacacatagaatgtgtcatgatcaagtcaggctattcaggctattcatcacctcatgtacttattatttctgttragatatgttgggaacacatccatgtgttcctatccatatcaatgtgttgggaatgttttaagttctctcttcttgctgtttggaaatataccatacattttcgttaactatagccaccctactctgctatcgaatgttagaacttactccttctatctaactgtatgtttgtacccattaactaacccctctttatcctcacctccccattacccttcccagcctctggtaaccaccattctattcactatacatgagatcaattttttttaatcctatgttcatagatcccatgcctgggatatttgtcattctgtgtctggcttatttcgcttaatataaggactgccccccactccattcgtgttgctgcaactgacatgatttcattcttttttatgaccagatagtatcccattgtgtatatataccacattttctttatccattcattaattggtaggcatttaggttgaatctgtgtctctgctattttaaatagtgctgtggtaacacatgaatgcaggtatccttttgatatactgatatctttttcctcttctacttttttttgtttatttttttgtttgttttttgagacaggttctcactctgtcacccaggctggagtgcagtgttgtgatctcagctcactgcaacctccaccacccaggctcaagtgatcctcccacctcagcctcccaagtagctaggaccacaggtgtgtaccaccatgcctggctaatttttttttatttttggtagagacggggtttcaccgtgttgcccaggctggtcttgaactcctaagctcaagcaatttgcctgcctcagccccctaaagtgctgaaatgatgccctccctcccttcctcccttcttcctttcttcctttcctcctttcctcctttcctcccttcctcccttccttccatccttaccttctctgtctttctttcttttttctcttttctgataaatagccagtagagggatacctagatcatatggaatgtctggttttagtggtttttttttttttttgtagagacatcttcatactgtttttttttaatagtcactgtactaatttacattcccaccaacactgtataagagttcccttttctctgcatccttgccagcattttttttttttgtctttttaataatagccattctggctggggtaagatgatatcttattgtggttttgatttgcatttccctgatgattaggaaagttaagcgttttttttcatatacctactgggcatttgtatgtcttcttatgagaaagtgtattcatatcctttgcccactttttaatgagattatttgcttttttttttttttaactcttgacttgtttgagttccttccttgkatactctggatattataccttgtcagatgaatagttagaaaatattttatcccattcaaccagttgcctctcattctattgattgttttaaaacatttagtttaaaatagtcccttttgcctgtttttgtttttatttgtgcttttgaggtcttagccataaaatatttgcctagatcagtgccccgaagtgtttcccaatgtttttagtaattttatagtttgcagtcttaataaagtctttatcttgagttgatttttatatgtggtgagacataggggtccagttctattcttctgcataaggatatccagttttcccagcaccacttattgaagagggtttctttcctcagtgtaggttcttgatgcttttgtcaaaaagtaggttggctgtaaatacagggatttatttctgtgttttctattctgttccattggtctatgtgtctgtttttataccaataccatgctgttttggttaccatagctttgtgatatattttgaagtcagatagtgtgatgtttccagctttgttctttttgctcaggattgctttagctatttaggcttgtttttggttctgtatgaattttgggattgttttttctatttctgtgaaaaatgacattggtattttgatagagattgcattgaatctgtagattgctttgggtagtgtgatcattttaacaacgttaattcgttcgatctataagcataggatgtctttccatttgtgtcctcttcagtttctttcatcagtgttttgtagttttccttgaagaggtcttttccctccttgcataaatttggtcctaggtattttattttatttttgtagctttggaaaggggattgccttctttatttcttttttggatagttcattattggtgtgtaaaaacactattgatttttgtatgttgattttgtatcctgcaactttactgaatttatccaacgtaggagatttttggtggagtctttagatttttctagatataagatcatgtcatctgcaaaggggggcaatttgccttcctcttttccaatttggatgcctttatttctttctcttgcctgattgctttggctggaacttctagtattatgttgactaggagtggtgaaagtgggcatgctgtgttgttccagttcttagaagaaaggctttcagcttttccctattcaatatgatgttagctgtggatttgtcatatataggctttattaggttaaggtatgttccttttatgcctagtttgctgagagtttttgtcatgaaagaatgttgaattttatcaattttttttgcatctattgagatggtcatatggtatttattcttcgttctgttaatatgatgtattgtgtttattgatttgcatatgttgaaccatcattgcatccatgggataaatcctacttgatcatggtgcatggtgcatggtgcattattattattattattwtttttttttttttgagacagagtatcactctatcacctaggttggagtgcaatggcataatcatagctcctgggctcaagggttcctcttgcctcagcctcccatgtagctgggactataggtgcgcactactatgccttttttttttgtagagatggcatctcactttgttgcccaggctggtcttgaactcctgggctcaagtgatcctcccaccttgamctcccaaaattctgggattacgggcatgagccactgagcccaacgtggtatattatctttttgatgtgttattagattcagtttgctgatattttgttgaggattttttccatctatgttcatctgggatatagccctgcagttttctttttgtgttgcatccttttctggtttcgatatcagagtaatgctggccttgtagaatggattaggaaaaatcacctccctttgatattttggaatcctttgaggagaattgtgttaattctttgtaagtttggtagaatttggcagtgaagtcatttagtcctggaatttattttgttgggagactttttattactgattcagtctcattattcattgttggtctgtttaggttttccactttttgattcaatcttggtaggttgtatgtttctaggaatgtatccatttcctctaggttttccagtttgctagcgtatagttgtttataatagtctgatgatcttttgtatttctatggtatcagttatactgctttttttttcatttctaattatatttgggttgtcttttttcttggttagtctagttagtagttcaattttgtttatcttttcaaaacactaacttctttggttgatcctttgtattgtcttttaaagtctattttatttagttttgccctaatctttctttctttattttttaaatattaacttttattccctactacacatagtatttttattattattattatactttaagttctggggtacatgtgcagaatgtgcagttttgttacataggtatacacatgctatggtggtttgctgcacccatcaacccgtcacctacattaagtatttctcctaatgctatccctcccctagccccccaaccccccgacaggcccccatgtgtggtgttcccctcccggtgtccatgtgttcgccttgttcaactcccacttatgagtgagaacatgcagtgtttsgttttctgttcttgtgatagtttgctgataatgatggtttccagcttcatccatgtccctgcaaaggacacgaactcatcctttttttatgccctaatctttattattttttttcttctatttatttggggcttgattttgttcttttctagttttttgagatacatttttgggttgtttattggaaatctttctagttttttgatgtaggaatttattgctataaatttccttctttgcactgctttggttgtatcccattggttttggtatgttgtgtttcaattttcatttgtttcaagaaattttttgattttctttttaatttcttccttgacccaatggtcattcagtagtattttttttaattccatgtatttgtatagtttccaaagttactcttgtaattgatttgtgtttttttttttctattgtggtctgaggagataattggtatgatttttatttaaatttgttgagacttttttatgtggtctattctgggaactgttccatgtgctgatacaaagaatgtatattctatagcagttggatgaaatgttctctaaatgtctrttaggtccatttttgtgtaaagtgtagtttaaatccaatgtttatttgttaatttttttcccaatgctgagagtggggtgttgaggtcaccaaccattattgtattggaatctgtctcttcctttaggtctaataatattatacatctagttgtttctgtgtttggtgtatatgtttagaattgttacatcttcctggattgattcctttatcattatgtaatgaccctctttatctctttttactgttttaatttaaagtccattttatctgacatgtgtataggtacttgtgttcattcttggttttcatttgcatggaatatctttttctgtctttttactttcagtctacatgtttcttcacagatgagatgagtttcttgtgggtaacagtatagttggatcacgtttttaaatccattcagccaggctgtatcttttaagtggaaagtttaatctgtttacattcttggttgttattgatatgtgagggattattcctgtcattttgttaattgatttttggttgtttcatgtatcctttttcctttctttcttaytgtttatcattgtggttttgtggttttctttagtggtaacatatgaattctttctcttcctcatttgtgtgtttgctctaccagtgggttttacacttttgtatgttttcatgatggtagaaattatcctgtcacttccaagtgtaggactccctgaagcatttcttgtaggtatggtctagtggtaattccctcagcttttgcttgtttgggaaatacattatttattctacatttatgaaggataactttgctgggtatagtatctttactggcagttttktttgtttgtttgtttgtttgtttttttcctccttcagcacttcgaatgaatgtgtcatcccatcccattctctcctggcctgtacaatttctcctgacaaatctgttagtctgatgagggttcccttataagtgacttgatgctttttgtttttcttgaggtttttataattctctgtttgtccttgacttttgatagtttgattattatgtgctggagaagacctttttgggttgtatctgtttggggatccctgagcctcctatatctggatgtctaattctcttgctagacttgggaaattttcagctgttattttgttaaataggtcttctttccctttcatttttctctttgccttctggaacatgtaaaattcaaatatttgatcagtatattgtgtccaatatgtcacataggctttgttcattctttttttatccttttgtttctcttttggtctgcctgggttatgtcaaaagacctgtcttcaaattctgaaattgttctccttgatcttgtctgttgtctgttgttgaagctttttgaatgtattttgtatttctttcagtgaattctttagtaccaagatttctgtttggttctttttaatgatatctgtctctgctaaatttctcatttatatcctgaattgcttttctgatttctttttattgtttaatctgaattctcttataattcactattttttaaaatattattattttgaattctttgtcctggatttcataagtttctttttcattcaagtctattgctgaagaattattgtgctcttttgaaggtgtcatagttccttgcttttttgtgtttcttttgttcgcatgttgataatttgcacatctgatataaaattttcttattccagttttgggaatttactttcataggggaggatgttttcctgaagatgtatctatggtgttggttgtgtaggtcactttggctttgattctgagtatgtgaagtagtgtagtctccatataatttctttggctgtaaatgcatcagtagtgtctgtaatttttttttttttttttgagaccaagtttcactcttgttgcccaggctggagtgacatggcacgatcttggctcaccacaacctctgcctcctgggttcaagccattcttctgcctcagcctcccaagtagttgggattacaggcatgtgccaccatgcccggctaattttgtatttttagtagagttggggtttctccatgttgatcaggctggtcttgaacttccgacctcaggtgatctgtccacctcggcctcccaaagtgctgggattacaggcatgagccactacgcccggactatgtgtctgtaattctttaagtggctttgggtgtggttggttgtggaggctgtggcaaaggtttgctggggccggggatgtcagatgggtcagtcctgagcctcagtagtggcagttgcaggctgagcatgcctgttcttggtgtatgctggtaccagtgtaagaggtccaggcaggctgattcttgagcctccaggcttgcctgagtgggccaggcatgtgggtaggtccttaggtccctctgagtgtcaggtgtggtgtgggagatagcagtattagtgatggggcaaccctgtgggatccaggtggtccatactgtgttgacagtggctgcaacaggctgggagggccagtcgccaggcctgcagttggcacatacgtctgtgtgccaactgaggtgatagtggcagtttgggtgagcccatcctgagatccccaggaagtgtgctcaggtgccagtggtggtggttggggcagggtgatcccaaggcccctggatggcatgcttgagcactggaggtagacagtggagctgggccaggtggacgtgtcctcaggctcccaagtgctggtgctagctgtggtaggcaggggcggggtgatcctcagttctgcagtggaatgcttggtgggggtggcaatggctgtgctktggtcctactgctggggagggcggggttgctttcagtggcagcaaccacagacaggtggttggagagcacatgcttcagccccaggtggcagctataagcagagtagcctttcctcagggcacttttaagtgtgttgtagccctgctatcgtgggcagcagagttgctgccaatggcagtcagctgtggtggtagatgtaagcagagggtgtcagtgtagcttcagatatgtggagagaggagggtcttgggccccttgggtagatgcagtttggtgggggctgggttctcaaagtggtgctttgctgtagctgcttaggactagagggtgagggggaaggtgggaattggcatgagctctgtctctggagtaacgctgttgcatggtctccaggcagctccctacatcagtttcagggcccttttgggttgaggggctctcctgtggctaggattggagtctggtgggattgtggaccactggaggtcacttcccctttccctacatcgaagagctgttccaggcttctcgccagtcccagaacagcaggctgccttgcttccctcttcttccttgccttaggtgtttcctgtcacttctctgttgaattctagtactcttttttaggtggtctgtttaaagtgtgactatctacttgctatttctgttctttgtggaggaggtgagtaccagatgcctctagtcagccgtcttggcttctgcaagtttttaatattcacaagaataatgtactgcatgcatccttgtgcaaattgctttagtcattagcatatttaaagctatactttgtttattttaactgctttatatctttctggtaatattgtgatttattccttcaccagttgataaatatttgtgttgcttttgatattttaaaagagtggcaattggaattcatgtgtctctcgttaggcacatgtgtgattttttttttaaactagggttagaatcttttgatctagtgtatgaacatgttcatagttagtagtttttgccaaactgtttttcaaagctattgtactaarttttactttcactagcactgtaggactgacctcactgactcttgacattttccaacttggtaatttttgccaacctgatggaaataaattggatctcactgcagtttgtaattaattctctgattccctgtaaatgtaattttcttttcttgtgattattggctcttaaggttttctcttctgtgaattgcctatccacatcggtgcccctttttctgttggattgtttgtcttttccctttttgacttgtaagaagtctttacatttcactgtagagaaagtctttcttatgtgtgtttctaaagtttctactaatttagtttttcttttcactcattagattttgcagcacagaagtcytaaaattttgattagtcaagttttatcgatgctttttggtcatatttagaaatattcccctcttcagagcttataaatatattttttcattttcttcttaaaattatattttattatatgtgtattttcatattgcctgaaacggatttctgtgtttaaaataaatattcagtttttaagtattattacatgaatgaacagatacgtcattttctcaattgatgggtaaaatcatatctctcatatcaagttataatatgtgtgtttcaggctctttattctgttccattgggctatccatgtatttctatgccaatatcacaatgtcctaactaccatcactttaaaatgtagtattcaataacgcatctagttattagttttctagttgtcttgggtattgttgttcttttgtgctttcatatcaatgttcagggagtctgtcaagttccatgagaaacccttttgggattttaattttatcatgttaaatttatatattgatactgggaaaattgacatctttacatctctattcacaaaaatattttatttcttcatttatttaggtttgcttgtatgcttttgtaaagtcagacttattcctagatacgttagagctcttgttactgtaaatgtgttctttcttgaaataataactagaatttttttttctggtatttttataggagcagttgattcatatggcttgatgattaattcagaaaatttgttaaactctcttaatacagtttgtttataggtgtcttgcattttctgtgtaactgattatattatgtgtggttaaaaataaggttttttaaaaatttccagtttttttttttttttttttagacagagtcttactgtgtcacccaggctggaatgcagtgatgctatctccgctcactgcaacctccgcctcccaggttcaagcaattctcatgcctcagcctcccaaatagctgggattacaggcatgtaccactatgcccagctaaatttcgtatttttattatagtagagatgggattttgccatgctgtccagactggtctcaaattcctggcctcaagtgagccacctgcctcagcccttcacagtgctgggattacaggcatcaaccaccacgcctgtccttgtttctgtttgaaagtgaatgcttaaatatgacattcatgtcatatttaaatatgatatgaatgttttgaaagtgaatgcttaaatatgacaattagtgtacatgtttgatagctacttttcaataagttagggaaattaattatcttctaatyatagattgtcagaatatcatgaaagtgtattaaaaattgccaagcacattttccatgtcttttgagatgatcattggctttttttctctctttcaatttgttagagtggttaattatgtaaccacattttttaaatgttaaatcatctttgcattctggaggaaaccctatttagtcrtaagaaattgatatacatacaacccatttagtcatatatacacacaccccatcttctgtgtgtttgtgtgtatcttgaagatacatatttgatttacttgcattttatttagaaactctcatttatggtcttaaattagattaactcataattcatgttgttcttactctccttgtttgttcttgtaagatgattctactggcttcttatggggtaaccaaataaactgggaaaataagtaatagcaagtaattttaggtaggcttcagaacaaatggaagtagaatgttgagccacagtaacatgtaagatgggagtggaggcactggagagaaaacatatcaagggaagaggattaccttcagacttctagtcaagtgtgcatgttaaaatattaagactaagcattaaagaatagaaacaatgtataactcttgaaccaatagaagtggaaaagggagaatgcagtcagttccgttttgtctttaatcatttattatctgacattcttgggtctaatcctgctgtgaactgttctggggattctcacatgtggcatcctcctgtgtttttttccttttggaagatgagtttatattcagtgaggctggtttgagagaatcccgtgtggctggctgtgttgaggtctcgtcctccagagaagtttggtgtttgctagtgttaggyggtgagtgggaggagcatggggatatcaccaactcaggaccttggtttgtgttaatttcttctcctgagggttctcagacttgacaggtagtctaagttcaaatcccagccttgtgtgatttatgggactagagtcatgatttcttaagggactctttatttattttccaatctggagcctgagcttgacaaaacttccttgttcttcccagtgcaagtagggatatctttttttttttttttcttgatctacacacttaccaatacgaagatcttagagactgctagcttggtgggtgggtctcaattccaactcactgcctcagtcaagcccaagggctcatcttctgtttcccaatagtattaaagccctgtcctcatgatctctgacaatctgctgcctggacagcctttcaccttggtttaagttccctcttagcttagcagtgcatctaaggactatttattatactttatccagcacatcttagtgtttttagtgaatttttccattccttcctcttaggactgacacagaattctctttggaaatttgacaagtatgatgatgtgtaccttttctcagcatggtagacaatgggctataatagataaaaagtacttttattaacttacaatttatgtgttgcacagtttctttttgcatatgtgtatatcacattgatatacattattattttataagaagtagcattttatgtactttttcagataaacctcctaaaatttactagttgcatattcttcagcgattttaagtattctagtttaaaatcatttttagtggatatcagtattgttttgtggcccattttctagttattgtgacaaaacatctcactttttaaaatgtccaatttgaagctctaagaagggtgaggacttttttcttgttaatagagacttaatggaatttaattaaattctatgctgtctcttttctaatcttttttggagaaagaaaataggcctgattattttgaatttaagaataagaatttaaaaagtcttagaggtcatccttaccttaatttacaaatgagacaattgagattcagaacagttttggaacttattgaaaaacaaattagctagttgaaaatgagaatcagaaagagatctgctaaaccaaagctacaaatcaggcccccgccccggctcactctattgtattttaacagaagtggaggaagtaagttggtttgatttatatcttattactagttctttatcagcatagattacagtctcccttagagtatctcagtagagtacatatttacattcatatctaaatactaaatcacattggtgtaattactagcatgtgagtttatgccaactgttccttcttcctcttggccaatgagtatgtaattgtctttcaagagatggaagaacacatcagatgtactgtgagtggctccatgccaggcacttgggtgcatcagtcgtactcctagaaggcataatgcagtgccatgcccaacctggtatcctataaacgttcaagaatgtgtgcatggrtgaatgaattgcatggtgaaggtaaacaacatatgtgactctttagcgtttaggcttgacagatttgttataacttattttgagatcacacaataaggtgaggtaaatttctgagatttgtaacatctactctatagagcagccagtgagatcacttccctcgaaccctatcatcctaagacaaaataattgatgggtgagaaaagggcatgaatatgaacttctcttttcagttttgaggacaactgaatttgggaataatgctatcttatttatgtttttgtttcttgggcagggkgaaattctataacttcgtattacagagaagtttctaattatggtgatttggattttataatgagctttttggaaaagtacttattggactttgtatgagtgtatttttgttcttcccaaaatttcttgcaataaatatgagctactttctaaagatgaaaaaatcatctataatctcacctacataaattttacaaaattgtcattctatgtattgcttatgctttcctcctattttgcactctgtttttctccagtaatacaaaaagttgccattctgctttagtgtattwttcagttcagtggtttttgaatcagcatatttaactttatttttgaaaacttgtcacatttaaatcatctcatttttacttgagtaataagagaaaattaatatgtttacattctgcttccccatttcaagtttttatctatacagtaagtaattttaatcccagattattattaaattgctattttattaataggtatagcttctttcaataattatttttgatatttgctttaagttttataaccctatgaagaacaattatttagaatcatgttctgtgggttttaatgcttgctgccagggtcttgtatttattgtgtgtgtgtgtgtgtatttatttttttcttttctcaagagttaaatactatatacactttctctacgaaggaagtgtagatgaaatgtagatggcattctttctgaatactcacatttctgtgactgttctttattgtcctcgtatgaaaacatcaatgtaattggctatgtatctcaaaaaatttctctgtataatgggtctgttctgattctctctgtctttagatatttgacttgttattttttttctctaaactcttacaatttttctttaccattgagatcccaaaatctcatcaagatacacctacattttagttgcttttaattaactttgttttgtaatctacataaatttaaatcactaatctgagacctttctttttaggcaattacttgtcttctgtttggagctgtgtttttcaggttccttctaatctttcttggacccctggtgcatcttgaatttttttcctatatgtgccttcttttcttttgttcttgtcatctctgactcttttctgagtgttgggtgaatttccttagtcttctacctgccatttcagttttctggaatttttatacttcctttcattacctgcattgccatttttaatacagaaattgtttttcagtttgttctgataggcacaataatggcttccaaagatatccattacttaatcctcagagcctgtggctactaccttgcatagagaaagggacttttcagatgtgtttcagttaaagatgttgagatggggagtttctcctagatttttgggtgggctcagtgtaatcacaggggtcatcaaatgtggtagagtgagaaagaagattgagtgtcagtcatgtgagaaagacctgactagtcattactagcttttgaagatgacaggtagccatgagccaagagatgtgggcagcctctagaagttggaaaagacaaggaaacggattctcccctagagcttctggaaagaaacagagctttgccttcccggtgattttagtcctgtgagacctattttggacttctgacctctaggactgtaagagaataaatttgtatatttatgctgctaaatttatagcaatttgttaaagtagcaataaaaaactatttttgtgatgtttttactgatttcttttgtcttcataatggcttgttctattttcaatgttactatgttaacaaaacacattgaggacacaaatcagagatgtcccatcatttaatctttttctctttctatctcttctttttttcccctcccatacatctgcttcagtgggaggtgatttcttctttggcgagagataagtggccacctcctttgattacatttttccccattatgttccataattatttttctgtcattatagccctgactatcttattggcctatagtccaattgcagttaaattggattctctctgaaccatgtaggttttctgcctaagtctgtcggctcctgaagaagtaggaaagcccattcacactgcccttcttactgccattggaggtgctttcagggtctccactgcttattcttttgacctgttgctttctgcagacaataagagaggaggtttaattcctctatcagttcagtcctattgtcataaaactaactgaaattcctctcacttcttctcaggcatattataccctcccaatttttaattcctggtgtattttctactctttcaatatttagctgctaattttcatgaaatatagmgttcttatccagaatcctcttagtataggattttaaatctgaactagaccttatgtataagttagtccaatttcctcatttcacagatgataaaattgagtttcgaaaatcatttaagttttatcattaaatatgtatggtttttatggtattacagtcaattgttgagagaaaagaaatggcataggacagggcacttttctctacctttagagaaaatctgtcagttttactcatctttgtacattgtggcttaaagagataatttatacttcttaattttgccatccttaactttatcgtttttctctgtgggaagggctaagaagctgcatatatctctgcttaactttgttgctacttggtgttcagaagttggaatgctgggaaataatatacgcttgatatttggtttaaacatttcttgattcagagaaggtagatggttatagagactaatgaaaagaacagacttttatatttgtcttgacaaagttttaaatatcctttgcagaaagaaaatttgtaaagtttaaacatttttggaaatatctttaatttattaaggaaatcaatatgtatttagcatgtagtccatagaacagttggatactatacaacaatgaataagcaagctagaatctctgcgtttatagggtttcatagcctagtgtagaggggatcaacagataattaagcaattatgatacagtgattccctggaccagcagccttggcattacttgggaccctacctcagatctactgaatcagaagttcttgcgggttatgtcagcaatcagtgttttacaaactctcaggtaattctgatacaagaaaccactgttttcactgttgagaaccagagttgagagagagagcacagcacattaaatagagctgaagctgagagtttggagtcattaatatcttgagttgaggctggagaggcaggtaagtaaggtctgataagatgattgaaaagtttagacttttatctaacgtgcactcataagcccttaaaacatgtccagtggggaaacagcttgatcaactttgtcttttttttttttttttttgagatggagttggggtcttgctttgttactcaggctggagtgcagtggcatgatcttggctcactgcaacctccacctcccgggttcaagcgattctcctgcttcagcctcctgagtagctgggattacaggtgcccaccaccatgtctgactaatttctgtatttttagtagagagggggtttcacyatgttggccaggctggtctcgaacttctgacctcaagtgatccacccactttggcctcccaaagtgctgggattacagatgtgagccactgtgccctggactgtgatctctttaagaagcagacaagtaaagagataaataattatacaatgtattaagtataatatttgaagcataatctaaaagctattaaagtctagataaggaaagagactttagatgcctgggtaagtcagaagactaaccacttaagtatttcacgttgttcttggaagttttagtgtacaacctatggatattcagtagaatatttgatcaaaaatagtggttaaaagtgtcatatgttttgggtaatttattagattcaaagcaaaataaaaatgaaaaagtagaatgtgaaccgtcttcaagatatattttttaattttaggggtcccaggtaaacttagagcttcaagaagaatgacttactctatgtgatgtatacttttctaatttctagtttgttacttattttctaattttgtttaaatatattattatatataattacatattataattatatataattatatattatatattatgatagataaataaacatatattattctgttttaaactgtctcaatcctttttaaagtgattattataaatwttgtaaataataagcaaatatattcttatcaatgatgttgaagaataagtaaacatgttataaagcattttcactccacactttaaaaaatawgctgcatctaatctaagtatattttacttgtagaacattgtcaaagggtcacctactctttggaggttacgttgggtcctccaaaaagaaaaaaaattctcaaatgtcatagattggttgacaagtcctattctgaacttaaggagttgtgggggtaggcagtgctgaccacaggaatgttgagcagcaaatgctggctttgggcaaaaaacctttgatgcacagtgacttgtttgaaatgtttggaatgatggtccttgtgggaacctgcattacaaaatgtctgtcccacatggaacatactgtgtgagaatagaaatgcagaataatagggcaatgataccctatctagaaaccaactgtgtttacagattccctaaataacaggtcaaatagattttactatggtaaatattccaattgcaatgttctgcaaaatttttgtctgtctcatgtattttaagcaagatttcttggccatgtggcttttgtagtagacttcaatgacataaaaccactaagcagagaccttgtcatttatttaactccaactgcctttaatcttaaggacagtaatattgtgagaaaccttggagtttcaacataatcacaagatggtatgcaggatcaaatgttcaaattatttgcttttgtttttctgttgcatgtactataaaagtcttgtgttatctatataagctttaaatttggacctgtgccttctttttcatcatcttttctcctttttcttttagttcacagccatgaatgaaccacagtgcttctacaaygagtccattgccttcttttataaccgaagtggaaagcatcttgccacagaatggaacacagtcagcaagctggtgatgggacttggaatcactgtttgtatcttcatcatgttggccaacctattggtcatggtggcaatctatgtcaaccgccgcttccattttcctatttattacctaatggctaatctggctgctgcagacttctttgctgggttggcctacttctatctcatgttcaacacaggacccaatactcggagactgactgtyagcacatggctcctkcgtcagggcctcattgacaccagcctgacggcatctgtggccaacttactggctattgcaatcgagaggcacattacggttttccgcatgcagctccacacacggatgagcaaccggcgggtagtggtggtcattgtggtcatctggactatggccatcgttatgggtgctatacccagtgtgggctggaactgtatctgtgatattgaaaattgttccaacatggcacccctctacagtgactcttacttagtcttctgggccattttcaacttggtgacctttgtggtaatggtggttctctatgctcacatctttggctatgttcgccagaggactatgagaatgtctcggcatagttctggaccccggcggaatcgggataccatgatgagtcttctgaagactgtggtcattgtgcttggtaagttctgtcttgactgtaacttactttatagattctcagtgactaacataaaccacattattttatgtcagaggtaaccaacagtatgaatattcaccaggtaattcaccaggaattacaaggggatgaggcacctttatattaaatgtcagcttatgagtcttcctaaaattatagaattagcgttagggaaacatgggtcccagtggtgcagtataaatgatgatgatgtaaaagatgtcattgaagagtttggctrtctaatattgaaaataccagaattaccagtcaaactcattcatttttcttacagcctaaattgtgaaacttttgcattgtggtttctgtattacatattttcagacagaaagtgcttttgtagaatatgaatatgcttccatatatagttatttttgttagtctattctgtaattgttgctacattataggtagtatatcaaggttttatatagatttactgaacaaaacagattggaattaatgatattctctgacagtcatcttcatgaaaacttccttattttctattaattttctatttgtagtagtggaggttaattcatatttcaaggtgaagagcaagatttgtagactcaaataccttctgcttttaaataagcattgtttttcttggatgaaaaattcatagtagtgatcaagaagaatatattcacttatgtgtgtagaaggtagttaaagagcacctactatgttctacgctctgtgctggctccatgaaaaggacagatacagacatttcctttggagctgagagtagagtgagagttttttaaaataattacccaatggaattatacattctccatagactatattcaggttaacgtttgatcacattaaaaaatcttttttgaaaaccttttatcatttcatctttccctatggaaattgaaaaaaaacattttatcacctcctctttccccacagaaattcaatggaaagttcctataattctctgtgctccaatttatatagcatttttgggtgaatgtaacatgggattatgtggctcctctgaaactctgggaattaccttaattttagccactggaaggagacagggtcctgctgatcattatataaagtagtattcagattgatgcataggtctcgtctgttttggttaggatgactgcatcatggacatcattttcagctatactcattgttgaccctcttgtagacctgtgagaatagcaactaagccttgggatcactgacacacctaaaaccctgcctaactaactgaaacactgaggaccccatcacctcagatatgagattgtcttattgcatccaatgaagattagtagaactacaaaaatggtttctctgtatgtttattaacaggaccttaagcacacctgtgccacaaggccacattttccatgatgtggataaaacacatctttgtttaccatggatgctatttttgtatgaaataaaacatgagacattaaataacatgagacttttttcctgtattgactcaaatatttatttgctgatgacctaaatgttggttgacattttttatatgcatgaactttttctattacgacaagtgctactcatagtttgcagaattgccagcagcaaatgactactgaacttggactattaacctgccaagttcttgttttaattttgacctttgtataatatcttgtgtattccagtgtgcaatgtactgaatgattcacatacttttgtgcctctttgggttgtttttcaggttgaaataatcattttgaggctataggagctagtgtttcagtgtacatttgccctaaatgccactttcccatgcccaactactaccactgcacaaccactaactttaaaataacagaaataatatttaaactagtatactccacaaagatcgaatgcagttgacatctctggaataaagagcatgatttttaaagctgtgagatggaagaactttcagaacatggaaaaccccgtcacggtgataggtgaaggtatttggtgaagaaagatgggaataagattgtaatataggaaacagaaattaaatggaccgtagcctttttgagaaaagtagcaagaataagagaatgggcaggatgtgggcagggagtggttggaaagtttagaatggggaagtcacaatcctaacagatgtttttcaaggcgtggtgcctaatgccattcctacagtatgctcccctatttgaattgtaagtgtccatccttagataggcacggttacatgggagacatgggttggtcttgtcataatgtaggcaaaccccaaaattggggctcagcctgggggagttcttggctctgcccaggaaagaattcaagagtgaaccaacagtgaaagaaagcaagtttgttagcgtaacagtgtacagccaartgaccactccaaaggcagagcagggctatctcataggcagggtagcacagaacagcactaatggattgctggctagttatatttatacccattcttttttctttttctttgagacagggtcttgctgtatcacccaggctggagtgcagtggcatgatcttggctcattgtagcctggacctcctaggctccagcagttctcccacttcagcctctcaattagctgagattacaggtgcataccaccacacccagctacccagatttttttttttcttttttcttttttttttgtagagatggggttttgtcatgttgcccaggctggtcttgagcttctgggttccagtgatcttcctgccttggcctcccaaaatgctgggattgcaggcataagccaccatgcctgggcccccactcttaatgctaaatataattaaacaggttattcatgaacttcctggaaaaggggtggggagttcctgaaaccatgtaaggttaacttccaagtcattgccattgcatttgtaaaccgtcatggtgctggtaggaatgtctaatgcaaatgtattatgattcctggtccttgctggtttggattggtttctttgctacatcctgttttgatcagcagcgttgtgaaaacaagtcctgctggtctcccacttcagtaggaacaagaattctggtctactcgaagttcttctctttgtaaattagtccattgataatctggttattttactttagtttgtgtacattkggtttttagtatttgtcttcactgccagattgccaggtttgtgagggcaggcaggattgtaatgattgtttgttttctccacgttgccacattgcctgtcacggctatctggtacaaagtaggtagtcaataaatgctgagggaatgcatgtgatgacaaaaccaagtttctctgccttcaaaactgaagaccagagccgtagtgaattcactacagtaaatgccactttattcagctatgtgggagccaaacctagcgacacctttatgttcyatgccttctaaaatacaacagcctggaaaactcctggctacaatgggtgctcagtaaataatatgtttgttttacttccatttattctgggaatgattactcagtttccattttcacttcatcaaaatgatccctgggttttagacctattcagtcttcatgatcaaaagaagaatttgttggtcagcaactgacttgttatgagtcaagttatattaaaataaagtcatctttgagattaataatgggcaataccaatggctggtttttaagcatgatcttgtattaagctgcttttgagtgagtactggatcttaataattatttttagttgtgaaatacttatytggcataaatcatgtgctaccttagaaattagtatttgtaaattacaaccctatggcgtataggtactgttattgatttgttatccttattttccagttgataaaaactgaggtaaggagaggttaggtaactctcccacagccacacagctaggaagtataggaacggggattcaaggtcaggagctgggattcaaggttgggcacttgggtttcagaacccatgtgtttktcccctccatgttattctacttccctttaatcaaaacaactagcmgcacatgctgtatttagttataacatttgaacagcaagcagtgtgtgctattaaattgaaacactgtgatctcatttgtttctgttgaaactgcctagctgtgcygactgggctttgtttccctgggcagagaaagcttttaagggagcaatcttttcttccttttgcttctgatgaccctcatttcatccacccttttccactgtttcatgttgcagcagcactaactgatggcttctgattgagggaggattttgttcaaggtatagttaacttgaaggttcattgccctagcataaagtcatgtaatccctccctaggcttgaagtctccctacttgacattttaccaagaattccttctgagtcgtttccactattgagtcagagtggccgtcaagatgttcttccttatttgaccatggcatgtcttgaattataagtcctttcctttttggctgtattctttgtgatgacacttctgtccaggatacttagagaggaggagatccagaatttgaaaagagaaaatcatggttaagatgtgaagtttttacatctgagtcctggggagagacataaagtaaaatgaatccaggtgtggcttacctctttggggaagaagagggagacactgtttttctagtttgttctggttggaaacgatcaccatggaagctaaattactccttatgtctkacattctctgtactagggtcagtatgcggccctactcttcctgtgttgtttatactcttacatcaaggagttacattttcctcattttacgttgagggaactgaattaggataggttaagtaacttgtctaagatcattctttttgtaagtggcagaactggaaatcagctgtcagattcttgtagaccatgccttttggccacaggacactgactcttcacataccatggtgactgtcaccagtggtgacgaaagtggcaggagtcagataagtttaagaccatagttttcttattcactctgatgaaagatttaatttggctrctgtcctattagcaaatctatatgtgcttctcttttcagtttacttcaacaagcatgttgttgagtgccaattgtgtgctaagggataagagaaaaaattctttacagagcttatgatgtagtagaggagactaaaaaagagctgcaaagcactcgggttcatgtgctagtagaggtatgggcagagagtgatgacgagtggagtgatgggaggggctcccagaggaggcaatcttgagctgagtcttgctggatgtagaggagcttgcctcactgtagcattgggtggaggagaaggtgaccagttcatgagcaatgatgatcacctttgaggaactgaaagtagtcaggtgtgattagcacctagtaggtatgccagatggagttttgacaagagggtcaaaacctttataacatactgagaagtttgagcttctgtctgtgggagttgggagacgatgaagggttccccaagatcaaatgaacaccaattccttataggcagagtcctcacataatgtatcatccaaactgagatgcttttgggartgaaaacaggcactaactgttgggaatctgggataacaggagtaaatcaagactgtttagggcaacctaggatgaatggtcaccctcctccaaggctctgctctctgtttgttcttttttttgttttagagccagggtttcaccatgttgcctaggctggtgttgaactcgtgagctcaagtgatmtgctcacctcagcctcccaaagtgttgagatttcaggtgtgagccaccatgcccagccaatatttttttctaggttctcttttagtttttcaaatgcagctctcaacactggacttgtattgctgtgtataattggctttttttttttttaaggctggagtcggtccagatttagaattcttagaacttgaaaggatccctaaaaattatatcatccaactcccacatcttacaaatgaagagaccgagacccccaggttaattgagaacttcaggtcttagttagctcmtgatccaagccaggatccaagtttcctgacttccrctaaggtgctatttttactgcccctgccttgttcagtcccatccacactttccatcwtcatctttttttgggaacttcagccatgtatttatgtggctagccaggattaggtgtaaacattgtggctgtgaaggtaactggttctcaaaggaagagtttccttgaataggtcttcttataaccaattggtaatctccctccctaattaaaccttgaaaaaagttatctgaaactgaatcgcttgtacattattagcatcacatatagtagcttttcacatatattagcatcctgttagctttcttgacaacagcattatgttactatttttcattccacttggtttttatattaagtttgtgctctctctctcctctcctctctctctcactctctgtgtgtgtgtgtgtgtgtgtgtttgtgtgtgtgttcagttatattcactgagtcagggcacctctggaatctactctttgacaagaactatctggatgattctgggcaagttactttccctgtgttaattttttccgtatgataaggtgaccaatttgatttccaagattacttaggattctatttattctgtaaataaaattataaggacagtaactactgtggatcaaccatgtagagctttctagaggaaaacttgaaaggggactgggacaaaaataagggactatgattcttctttgtatgaacggtgcattccaccttcttttttattttttaaggctagtcaagtagaacagtgggagtggagaaagaacaaagaaatctgtaattggttataatcaattagttgtacacgtccctgcactcagaccagccattaccttctctmataataagcttttagatgcactatcccccattaaagggagtggcgagtgtataaaggatcctctcaaagagatgaatctgggggctttactttcctgtgggagagccatgtggcaggaagggaagacttcccaattggtcctgttgctaggggcagggaatggacacagagtctcttattccctggccacaggtgaccggctacacattctgttactctgaaggggaactaaagctaccccatgtctcctcaggtcccagtggcatccctgtaaaggcctctttgaggaagaacctgagcgaatatccatgagagcctcgattgtttggccagccattaggctgcttggcaccatgggtggtggccaggagacagtccttgcaaaagtcccacagtgcttcccagaccccacatcctgggcttgggtcaaaacagaaaacaactttcaaacaccagctctttatacccttttgttgcccatctccattcaaatattttttctcagaagaaacgtttaaacagaaacagaaaccaaaaataccacatgaacctaacagagttccttttgaagtgtggayagaggaaccagaacatgaagctcttattttaggtctgttgagagtgattcaggccttgtctggccgagactcttgttcatccaaatatgaatgttggaaagtcatttacttttccttgtcgttaaaggtaataaatgatgcaaagatttcttaaatgaattgtggtgaccactgagaatcactgtttcctaggggttgagagtttagatctggagtaagataggccagagtttgaagttcacatcctggctccttgcttacgagttscatagtcccaaataactgacttaacctctctgagtcttggtttcagaattaacaaagtaagaatcatagggcctttctcaagtggttgtgagcattagatgaactgatttatgtaaagcacatacatgtggcttacagaagacacttaatggtagcaagtattatcattactcttaggttgtgtcctcatgagaattcccctcctttttctttccctttctcttttttgacacacccacatccattcacatctacctacacaccaagtccacgtataatttgatgtkcgagatggtgcttcatttctatgacatagtatgaaattactattgtgttccagcagctgttggctcgaattatactctgtaaatttttatcccgaatgaatggcctttgcttttactgcagctttgcctacaccctacttgttgagcctcagccctatgtatgaaaaatcctgttagcatcacaggaaatgctaatagttctgatctgctgactcttcagagttggttaaatggtgttgactattaaaatgaactttggaatgtaacaggccactttgtcaatgtctataagaaagtcatgagctccctcagatggatctgcagtacttaaggcacagctgaaagcccaggcatcatctagggcagtggtccccaacctttttggccccaggaatcactttcatggaagacaatttttccacagatgggttggaggaggggggatggtttagggatgaaatgttccaacttagatcatcaggcattagttagattctcataagaagcacgcaatctagatccctcacatctgcagatcacaatagggttcacactcctatgagaatctaatgccgccactgatctggcaggaggcagagctcaagcagtaatgcttgcgcatctgctgctcacctcctgctgtgcagcccgattcttaacaggctatggactgttactggtccatggcctggggatttcgaacccctgatctaaggcaccattctgttattctgtttccttttgatcagcagtgaagggccatgtctggcatgtatggaagaaatgacgaatggctggggtcatgagacctgattgctgttctctagccggtcctagcttcacagtttgaccacctgtgaatcctttagtctgggattcatcgtcatttacttacaaagaaaatgctatttattaataactcctaatctctcactgctacctcatgaatctctgtgaagaatcatcatggcttttctatgatgccagggctttatcttacttcccagcacctagaataggtcctggcactctagatatttgctgaatgactacatgaaatatacctcttgttctggattgggagttttacaggttgcctagttacaatagtaatatacccaggtagccaaaaattcaatgcgatttgatagtggatctcattcaaagggatatttgccataaggtygttataattaagcagctacaactcctgcctctcaggactttttttaaggctaagttccagtgaaaacttcccgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacatatctacaaccatctgatctttgacaaacctgacaaaaacaagaaatggggaaacaattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaagagcttctgcacagcaaaagaaactaccatcagaattttttttgcaaacttgttaataatagtttattttgtcagcaaacatgcattgaagtcttctagactctctgttaatgagtatgactgcaaagatcaacaaaaatatgtatcctgctttcaagaagctctcactgtagcagataatgacagataatttaaataagtgcaatataacatggtaaataaacacaatataatatgacaaaacaggcaaagtgctatgtgaatgctgtatttcaccgggcaatgtctggaaaagacttcaagatgaaattgatgttggaatttcatcttagatgatgtatagaagtttgctaagtaagcctaggcaaaggaattatttctattagatattctttataccctgaattgaatraaatattcaattacttttcttgtattgtaattagtatttcacttagctatgacaatagccgttgttaggcatgtacatcttgtataaatccttagagtggaaagggaagcttccagaattgtcagacaatatttacttagaactttctggctgcattttgcactggcataatattcacctttttttttgtttttgtgacggaatttcgctcttgttgcccaggctggagtgcagtggcgtgatctcggttcaccgcaacatctgcctcccgggttcaagaaattctcctgcctcagcctccggggtagctgggactataggcacgcgccaccacgcccggctgattttgaagttttagtagagacggggtttctccatgttggtcaggctggtctagaactcacaacatcaggtgatccacccacctcagcctcccaaagtgctgggagctaccaagcccggcccaatattcactttcttaattgactagagatagcaatttgacatcatcaaactggttatgaagtaaatgggttttgaatggttactgacctataaggaaagggattaatttatttttatttttatttttattttttgagatggagttttgctcttgttgtctaggctggagtgcaatggcgcaatctccasctcactgcaacctctgcctcctgggttcaagtgattctcttgcctcagcctcccgagcagctgggattacaggccaccacacccagctaattttttgtatttagtagagatggagtttctccatgttggtcagggtggtatcgaactctcaatctcaggtaatctgcctgcctcagcctcccaaagtgctggattacaggcgtgagccaccrcgtccggtggaaagggattcatttctatatgtcagattaacatcctatggagaagaagaagggattgacagtgacgtgtatgtgtttcaggatctgaaagatcattgccaggaaaagtcgacacctatacctgaaacataacgagaatataattttctatggtgttttacagtctgtaatggcctggttgaggtttcagaatgtcttcaggtgttttttgttattgttacagcagtagaattcacaggcagctgtttcatctggaaatgtatagttctgtttttgaggggtttacgttctttgcaactcgaagcatcatttctgatttcctgatacagattgaaaaaatgagaatgaacataggaggcacacatatgaattgccraatttagccaataaaaataattgcatgggatatacttatactaaaaaacaaatacttcttttttatttgaaattaaaatttaactgggtatcttgtgttttatctggcaactataacacacacacacacacacacacacacacacacacacacacacattattggctgggaaatacagcattttagatagcaatcaattctatattacatggattttctcctttgtcttataggcttccatattatcctggagttcaatttaactatacaagaagtttcacttatttactatttctgcattttattttgagttgccttgaaataaaggattgtattcagtttatagaatcttgttttctcagaaattttgcttgcttatgaacaggtaatgttgtaaacttctgtgtcaaaattgaatttttcccttctgttacatagtctttgtcatgctctttgaaaaaagcattttaatgaaatttgtttttttcatataaacaatttttttcttctgttggtacctttgatattgtttttctttgaggcctaactagagcctgtgcctctgagaagctactttctgttcatgtattttagtgaagatgatagtgtctagactgaatgtggtcatggctttacttaaaccctggcagggctcctgcacccatagaggagttattataatgatccaaagcaaatatgaggttctaatagggtgacacagcaataacagggtctttttgaagaaatgggatttaatctggcattgggagactggaaattcatggcttcacttatttattctgcccaagtagacttttgttgacacaaagaacactgcattttaagttgggttttccatgagttcattctaaacaggtatttctgtgcttcaaaaagcttctcatatttatattgcaggcatgaactcattcactcaagttattttcctttctcttgggagagagaaggtagccacttaggagcctagccttaaagaacatgcagaaaagatggatgaagtgaacagtccagaaggttttgctgtagccagcaagtgattcaccattttatgctgaagggattgggtttgctaaccttgccaagcacgtggtactcctttgtatattggtccagtctgagaggaaaggccaagctataaattgaggagctggaatcagtgagtttctgaactaaagcaaaagaggctstatttagacattctttaaaaggtgtgtgtgtgtatatgtatgtgtgcgtgtgtataaaacgatcagacggtagagattagagcactggctttgtttaatttggcaaattctaatgttctagaagaaaagtgaagatgttttaattaaaaacactatttctaaggcaccatacatatattctagagtaccagtagatgagaactacttatttagagtggcagagcatgctatagaaacaaaatatgagtaattctaactgtagttatgttatattagcrtagtgagatagtaacattaatagaattccttagtggaatttcttaatgcttcagttcaatctaaattagtattaatactttaaggcaggaaatctgtccgaaagcatttgtaaatttaaaaagcattgaaatgagaagcagaaacaaaaaatattcatttctatgtattgctctatctatattatataactgatttactaccattaaattataaaatattacatgttcagtgtattgtccttctgcagttactgatttataactttaatagtaacagatgtagctttattactaggaagcttattgagatcatgggacatttwgacccattgttttgattaaactttgaggacatttttgtactatctttataaatatggatatttaaatcagaattacagtaacattgatttttattgagaagacatttctagagtatatattattaattcactttaatcccttcaacatatagcacagttaaaatatttctagtttgctacgagtttcagatatagctaaaattttcatacgactaaaatctttgtgtatgtcaaagatttgtgtatgaaggcttaacttattgattagttttttaacataccaaattgcagtaactaaaycatctactattgtgagttatttttcctctcacgtttacttttccttrgccttattttacagctaaattttataaaaaagatttgattcatttttgaatcaaatcaaatttattctaatatgtaataaactttattgcgtgcagtttggctgttttcagttttgttttcaatttttcctacttttcttaacttttcctaggtcaatatttttagttctgagagtttctaaaaagaaaatataataataatggttaacatttgagtgtttactagttttcagaactcattaagtcctactttgtcccaaattgagtataactttgagcaagaatcttaatctctctgaatttcagccccttcatctgccaaatacagaaaatatattttggtgaggatcrtattggataatgaatgtgagagctctttttataggaagtgccacacaaatgtaagttatgaatgttttcgcagctgctacttatagagcagtgacccaaattaaaaaaaaaaaaaagtgtggaatgctaagtaaaaaatgtgatgtagtgtagttgcaaaggcgttagctgtattctaattccagatttgccacttactcgttgrattgactttgggcaatccacttaacctttacgacaacttctttatctgtaccacgaaggacttcgctacgtcagtgtttctccaggtgtggtccaagggccaccttgcatctgagtcacctgggacacttgtttaaaggctgatttttgggcctcagcccagactattgaaacagaatctttgtgttgggattcaggcatcagtacttacgtcacacaaaccttcaacaatgaccgtgtgaggagttgccggctttggtttaaattacatggcattcaacctgtccttgctcaattttaaaacccttttcaccttttccactgaaatgggcacatttttggtactgtgagtatccgtgattgccccaggcatgtgagtttgcacacttgctttacaggggagaggatcagaagggaaaaggaaaggaaaggagagttaggggaaaaaaaaacacaaaaccactcggacaaaattcttggctcttgaagagctatgaaagaaaatagattgtttcacactaaatagactttcctctcaaaatatttgaaacatccacactaattagttttatcaccctaggaaaatttgtcacctgtaaattaatgtctgaaaatcacctgatctactaaaaggtatcttgagaaattatggggtatctaagaatgtttcaagtaggcatatgattttatattatcctgaggagaaaccatttgtttcccccaagaatgaggatggagcaacaatgtatatttatttttgcattaacctaatacaattgtatgtgtctgcatggaaacttttgtagaaaaagggtaaatcaatcatttgcttgttcataggctttaatttcttcctgagtcagcatggtataatctgaagagcttgggagtcggactcacatgtccttgtgtgcaaaaacccagttctgggctgggcgtggtggctcacgcctgtaatcccagcactttgggaggcctaggcgggcggatcacgaggtcaggagatcgagaccatcctggctaacatggtgaaaccccatctctactaaaaatacaaaaaattagccgggcgcagtggcaggcgcctgtagtccaagctactcaggagactgaggcaggagaatggcgcgaacccgggaggcagagcttgcagtgagccgagatcgcaccactgcactccagcctgggtgacagagcgasagtccaactcaaaaaaacaaaaaacaaaaaaaaaccagttctgatgacatgttaattgtgtgacctagagcagtatatttgacccttctgagcttctattcccatctataactgggtagagtactgtctcccaaatgaggagattgytgagaaaattagatttgttcaagtgcttagcatgctgcctggcacatgctgcggtgaatgtaatgttctcatactttacctgtggctcacatacatgaaagggccacctgtggcctgctgtgattagtggttggagctgccttcccaggatgggcattccttgaagttatctagcttcttttataggcctgtataatgatgagtggcattttcccattctctgcctgtacaaggtgatctgaaggttctatatggggattccactcgttagtttgtatatttatccagaaattcatcctctagtcattcattcaatcaatgatgtagaatcccagcaggattctataaactgtcatctatcaggattatgagactatcaggaatatgatgttcatacaatcttccaaagccaggcttgaattgtctatatgggagcaatgataagtggtttttcagcatctgctcaagcatcttggatacacggaccaatgtatcccccaagaggccagacaatctttatatatatggactattttatatatatataattaaatatatattatgtcatatatctatatctatatccaaaatctcaggaaaaaactgtattttggggtgccatccactaagcctatttgtctccttgggtgccataaagagcactgcaactatatacaaaccaattcagcgtgggtggcatattgcctgttgtgtgatgggaaaacaaataccaaaatgtataatccctattcacttacaaatatgactaaaatacagggagaatgggagtcagactcatggcagatgtaattatgaagcaaatctggccgtgacatgccaatgcctatagtctggtaggaaggatggcacatatacatagataattattgagaaaggcaaaaggtgacaaaagtaccataaaagaagtacaaataaagctgtatgagaatttagaggagagagactatcttgttggaagtaaaatcaggaaagctttatgtaaatgaattttatgtatgacttggctgttgacatacaggtgatgtttagggaatgaagtattagactgcatttaccttgttaagtactgaatcttattttaatcacatcacatttcctctttttttttttctaagagatagtgtattgctatgttgctcaggctggaattgaactcagtgggctttagtgatcctcctgcctcagcctcctgagtagctagaactgcaggtgcatgccaccacacccagcttactctttttttgattagcaaactaatgcatattcattaaggaaaaaaaagaaaatcatttagaattttaccttycataattaaccaaaatattaagttgaatatactgtttctttctagtcctttgctaattaatagtttattcaattcatataatgcataccactttatagattctttaaaagattgtcttgagcatttattatgccattaagtaatctttgaaagtgtgatttttctacccaaagttcrgtacattcatatgatgaaatatataatcattagacatttacgttttcttttttttttttttgctattataataacattaagataaatatctcttatgattccttcctcacagagtaatgaatcataatgacttattgttaaatgttcttcagaaagcttgtgccaatttatcacaaggggattgggagtcttttgtcacattcatgacaatattggattttttttartggcactatgttacaaccatttgtgttatctttattcatgatgataaacattagcaaacctaaaaaagagatggaaactttttaaggatttagaaaccaagataaacaaaaataggaatgtatgtggccacataaaaatatatgtactcctttgaagtactttgttccatgtgaaagtctagtgtatatttacttctttagaaatctaaaggcctaacagctgaaaaagacagcgtggtgattaacagtgttacttttgaagtcccaacttcctggattctcatcctgacactactgcataccagcagagtccgcttgagcaatgtatccaatggctgcaagctccagtttccttgcgtgttaaatgagagacacagcagaaacagtaaaacctcaaaaggttaagtgagattattacacaaatgtttcctgacttagcggtggggttacatctccataaatccatcgtaaattgaaaatattgtaagttgaaaatgcatttaatacacataaccttggaacatcatagcttagcctatcctaccttaaacatgctcagaacacttacattagcctacagttggccaaaataatctaacacaaagcctattgtacaataaagtgttgaatatctcatcgatttattgaatactgaaatgaaagtgaaaaacagaatggttgtatgggtacccaaagtacagtttctaaggaatgggtgtatcacttttacactgtcataaagtcaaaaaatcctaaatcaaaccattgtaagtcagggaccgtctgtataagatgccaagtttataagtacttggtaggtactattataaaatacatgatacataacttgttttcatcagattatcatattgccatgctgaaatctaaagtccctgaattaatcctcattgtggcagatctttattatgtcttgagcaggaccagaccacaagggtcaggacccatgatgcttctaggactcagtggggcaagtctcctttgtattgagtggtgttgccatgtcaaagcatggacacagagaggagaatatcacacactggggcctgttgggggttggggggctgagggagggatagcgttaggagaaatacccaatgtggatgatgggttgatgggtgcagcaaaccaccatggcacgtgtatacctatgtaacaaacctgcacgttctgcatatgtaccccagaacttaaagtataataataataataataataataataataataatataawaatawgaccttgaaaacagatatgcaactcactgctgagatcctttacttttctatcttccctagacaactttaatccctaagtaatattcccatgacgtctcagttcagtgctcatactgtctcagtttttttacagtgccccaaagctaaaagaaatacctaacagtttcatttattaaatcaacttaataagtatattcaacttaattagttaattcaacttaatacgtatataggtcctgataaattagtagccattttgtaaaacaaaaccatataaattgaaagaattatcatttttatctaatccttcatatttactaaggtatgtatgcacctgttgggcactgcacaacttttcaaaacttgaattcagattggaaaccaccatcttcattttctgttccacactgagttttatgtttacacttcatttttattatagcagatatcatattgcaaggacatgatgtcattgaaaggaatgtaatgccatttaatgttgaagcgctgaactactttatgctcgtagttcagagggtgtctgagagatgtcgagtgttagctgccctcaaattaaaaatatctagtagcattcctctgaattcactgtggcaccccaaggttcctgggggcacagtttgggaaccagagycttacagtatttctggtttctggctttacttcagttttgttttctttcatctcattgactcttcttccccagttcctacttttatttcttggttccagctctctggttactttctccgctgctcaggtccgctctctgcatactcaccatcaagcagcagcagtctctgtaacttctggacctttgcagacctagatgcagccccgtaggctctgatgtggtttggtagctggctgtaggtcaattgatgtgttctaaattctacaggacttcttcagttcacaactccagggagcattaygtccatcataacctgccctaatggcatgcctttcatgtggctggccattagcttctgtctgtggcggtctccctgcaatgtgggtgggcttgtcctccacatcaggtctcctagctcactaggaacactctgctttataacaacaagaccacctgtatgctgagaccacatctcatcgctccttttcttggagtatcaacccggaaaatgtatttgaaacagttgagtggttaattgtggactccggattaacctgcttaattttttttatcataggtttactacttactctttaacttcctgaaacttcagattcctcatctgtaaaatagagataattgacttccttcatgtgagaatcaaatgaaaagttatgtgatgccctttagtcaatgtctgacatttattaaatgttaactgttactatatttttctgacagtaatttcgtaatttacttttaactattttaatgtctttaggaacagagtaataaactactggctcttaaagtttagtttgtcagttcatgagaggaaacataaatattgaaaggaaaaatacattcatataatttcctttaattaaactgagataagatcttgctctgtcacctatactggagtacagtggctagatcacagctcactgcagcctcaacctcctggtctcmagccatcgtcctacctcaccctgttttttgttttgttttgttttttgttttgttttttgaaacagggttttgctctgtcacacaggctggagtacagtagcgatccttgcttactgcagcttcaaactcctgggctcaagggattctcccactttagcctcgtgtgcagctaggactatagtcaagygccgtaacgtctggctaattaaaaaaaaaaaaatttgttgttgttgttgagatggggtctcattatgtttcccaggctggtctgggactcctggcctcaagtattcctcccacatcagtctcccaaagtgctgagaatacaggcatgggccactgtgcctggccacatttggtttatatatactacaatatctttgtagacatattatctgtgatgatttttatgaaattgtaggtatgatagtgcagatagtgttttacccattttagagatgrtaaaacagattcagagagatgacgtgaattactgaaggaaattaagtatttgctagaccccataccctaacctaggacttgtagtttcaatgctggtgctcattacttgctattttgttgcctttagtatttcaaaaggtaaaaacaaaagaggaagggaagaaaaaaaggaaaagaagattgttattctctgatgtctttttaaacaatgaaaatttgctatttctgctgtgtctagtatatataagtattataatgattttaattagtgcataaaaatcacaacagttgaaaaaaattgccaatgctctctcattagaaataatttcaaaagataaattgcttatcgaccttacttgaactatgcatccaaagcattgtattcatcactcagaaaagtataatgtaagcattggtaagtttgatttccagttgacagaaaaatgcttcagaaaaagagacaaactttcccttccccccattctctacttttccaaatattcagatgcctaaaccttccacccatgctagagctgttgctgcctaaccaccttctgggcacaatggcatggaaatacataatcagggtataattttgtgcagggcagagagaacatgctattatggaatcaagtctcagctgaatagcctggcctttggctgtgttttgatctcagtgctaaaatggaaatgaaacgttgcctcctcctttgtggcctatacaaagtttgctgattctgtgctcatttggtgattttcatgcccaagtaggtgaagggagaacaactacgtacatagatgtgcagctttggggttgaaggcattgatgtgtgtgtgctgagtcactatgacaatctaaagaggactctctggtggctgattagaaaattgtggaagttacaggctgtctgggttaaacatttcctggtttattggaggcagatttccttgggccagcaagcattgaaactcccacagtggtgtcatgtgatggttctccagcgaagcaytttggatatggtgacagctgctttagtttaagtatctggaacatctaatgtgggagaacttggctaagtgatgtgagaagttaagagaggagtctgaagtttccgttacatttttttctgtttagtggattaaaaggcaattcccatgcaaattgtctctgtctttaggtgttgtattcattttctatgctacatcgcaaattgtcacagacttagtggtttaaaacacacccatgaattatctctcagtctctgtaggttaaaagtccaggcatgcttagctgggttctgtgcttggggtctcacaagctgaagtctgcgtaccagttgggttgcattctcatgtggaggctcgactagggaaggatctgcttcaagttccttaggttgctggtagaattcatttccttgtgactgtagaattcatggcaacttgcatcttcaaggccagcaatgggcggaggcagggggtgggcagagggagagagggagggagagatagagggagagagagagaaatctgtacttcttccagtctctggcctctgtgagagctcacttaagtcagtccaactgacccagggtaatctcccttttgagcaatttattgtcaatttaattacatatgcaaaaccccttcacttttgctatttgacagaacctaatcaagggagtggcatcctataactgtattctatggctagaagcaagttacaggttctgctcacacaccaggggaagggggactacacaagagtgtgactcattttggaacatcttagggtgtgtccaccatagatgtaccattttgagtacagatggaaaaaaaaaaaccagcttttcaaaaatgctgttttaaaggaattgatgttgttaggttgaaggctaaaggatggaatgttatgtatttaaatgtatacttagtttttaaaaagtttktgccaggaatattagtcatctgttaaagaatgtatcatctagtactttctttttgaagttttctttaattttggctacagagacattactcttctctgagtctcatatctctttacctgttccttcacttccccttccttcatcccttctgtttgtttttgaaatgctgcatctctaacctgacagttccttctgtccactcacctcaaggatggctagaaatcttatacccagaccgcttacttcctgaacacagtggcatggaaacacataatcatgatgtaatcatgagcctgtacataagccagctactctgttgggttcaggttgtaacctgagtgtctgcagaatggcctgtgggtgagagaccttagattgtttcaatctcactgttaaaatataaatgaaaatttattttctttttggtataggaaacatgctggtttcattcatgttgggtggttcttatgtccaatagcagtcttacataaacagtcttacagaagtgtacagagtatgtgcctgtttatttatacttaatcttttatttaaaaaaggatttggctggtgcagtggctcacacctataattctagcactttgggaggccaaagtggatggattgcttgagcttaggagttcgagaccagcctgatgacatggaaaaaccccatctctacaaaaaaacaaacaaacaaacaaaaaacaaaagttagttgggcatggtggtgcatgcctcttgtccsagctacttggaaggctgagttggaaggatagcatgaggcctgtaggtggaggctacagtgagctgtgatcgtgccactgtactacagcctgggtggcagagcgagacccagtctcaaaacaaagtatttaagacagcttaaaaagatgcattcagttcagaggacaaagttgagtttaaaataagcaagaaaaaggagggaaagggaaaaagaaatctaagaaaatgacatggagtcaggtaaagacatactttctagcagttaatgaagatgtaaaacacaataacgttcatgatttggtggccataaagtaaaatcaggagaaataacccttctaagtactgagtccaaagagacatttctcatttgggtattgctctgtgttggatgcatcagctatgatgtgatgttctggagagctctacattctttatggcacattcagtaccatgtcccataaagtcatgccatatcatttctcagtgaaggttggtggtctgtaaccaaagtgcagttcaatgaaagcaattctgtggggcttaaagatatagcccagtcatgtggctttctaatatattggttggctccctcaagaatcaggtttagcatagtgtttcttagtcttattaaaaacgtattgccctgcccctgaaaagcttaagaactttattattattattatttttgagatggaatttcgctcttgtcatctaggctagagtgcaatggcacaatcttggctcactgcagcctccacctcccaggttcaagtgatgctccttccccagcctcccaagtagctgggattacaggcatgtaccaccatgcctggctaattttttttttttttttgtatttttagtagagacgaggttgcactttgttagccaggctggtcttgaactcctgacctcaggtgatccacccgccttggcttcccaaagtgctgggattacagccgtgagccgctgtacccggccaagaacattttaaagtttttttcataccttagcttatatttgaaaagaagttattttatcttccaactacaaagttatyacaatattgacaatatacacactcagcactagttaatctgccctcaacaaccttaaaaaaaaaaaaaagactttattttggcctatccaaaagaatgaattatatagttttccatgcatattgttacagttattttttccaagtttaaaaaatattatctttgttgctgacatctggatataccttttttataatttctagttaaagtgagtggagtttttttagggggtggtttgggagtaattagcattctctagagaaaactggaggactttaaaaagacatctgcctcattaggaggctgttccacctcagctacaagacagaagaggaaaaaaagtatggccaacccaagggtttctgcataataataataatggtcttcctacggagggtctgagtgatccaggccacctgggtctgagtcacaaagcctgcatgcaatacttattattcactaatttatttctggttataaaagtaaatcgtatcctatgtcaatgttttatagtatacagaatcatttaagtaaggttacaaaagtgattctgaacttgaccaccaccattttgacatacttccatccagtgtatttttttcttgtgccaatatagcatagtggctaagaacaaaggcctctggaggcatccagatttagagtaagatcccagctccgtcattcctagctgtattgcccagagaagtttcttgacctctttgaacctcagtttcctcatttgtaaaatacaggcagtcccatctcgtaaggttattgccagggactacatgagaagtatattcaatgaggttattagcacagtgccaattatatgacagacctcagtagatactggctattgcatgctacatgtgtgtatacatgcatttaaatgtatatagtagtattatataattgatatcatactcaagkttcccttatcctttaaatttaacrtctaacattttaccataaggttatatcactgtatacttacctgtttgtttgattttagtcattcatgttattaccatgattttcatattgataatttgataacttatattgacagaagtgagaagtaagacactcagaagtaagcaagagaggaaaagaaggcacactcgttcaatttttcttctttctcagggtagtcagtgtttcrtttttgatgataacgtatggaaaaatagctaaaatctacatctaaggaatttaaaccattcatatccatttacatcttcataattccagaaatttattctaagaaaaatgagtatgtacaaatatatgattgtggttatatgtgtacatacacatgtggacatatgtatgtgtgtatatatacatgtacacattttgaataatatgttcacagattaaattctagagatagaattacagatacttttttgttgtatattctcttttttgagagacagagtctcactctgtctcccaggctggagtgcaatggtgtgatctctgctcactacaacctccacctcccaggttcaagtgattcttcttctgcttctgcatcagccttccaagtagctgggattacaggcacatgccaccaccccggctaagttttgtatttttagtagagatggggtttcactatgttggtcaggctggtctccaactctttacctccagtgatctgcctgcctcagcttcccaaagtgctgggattacgggcatgagccaccatgcccgacctgttgtatattcattttcaaatattctacaatatgtacttcttattctcatcatcataaaatagcaataaatattactgtttttaaaatgaaagaagataaagaaaaactatgaatcataagcacactttagagagtacaattatacagggagtttaaaaaccatcaaaattatccttaaggacaatgtctgcatcttaaatgagagacctcctagactgcaagtgcatgcagcttgcacaaaggggccctcactatcattctgatcattaaattctttttttttttaacttgcgaaatctgttttattcaagtttctttcaagccaagtggctagaactaaggttaggtttcatttttgagtatgagattagcagttgtcttagctcgagagctaaaacattaattttgaagcaggaaaggtaaaacacagaagtatcatctcagcaagcaaaataagctttttttccccccttgagtctttaatgaagaaaggaagtgaaaagagataaaaagaggcctgtctctgcatactgtactaggcatcttccatgtcagtatcagcattctgccttcctcgayaagactctcagcctgggaaagaaggaaaccaagaattatcctcacaaccagaattgttctagagattttgtggaaacacatttattaaagactgatatagtttggctgggtccccacccaaatctcttcttgaattgtagctcctataattcccatgtgttgtgggagggacctggtgggagttaattgaatcatgggggtgggtctttcccgtgctgttctggtggtagtgaataagtctcatgagacctgatggttttacagggggaaacccctttcacttggctctcattctccctcttgcttgccgccatgtaagatgtaccttttgccttccaccatgattgtgaggcctccccagccatgtggaactgtgagttcattaaacctctttttctttataaattatccagtctcaggtatgtctttattagcagtatgaaaacagattaacacaaagacatttgtgtacacagtgataaaatggtttaaaagttagggagacagctacataagacaaagggaaacaggattagaatcaggcaaaggagtttgtaagttcttgggtgtggagcttgctttctcctgggaagagttgccttttgagatgctgtcatcctttgaggacaggaaccaaaggaaaaaagcaatgagggaacttctttttgtcccaaatcgcctgccaaaaataagtcagtgatgcttgtcaagcttggacgtgtcttgttcatacagtctggtaatagccagctttcttgtggaaaaatatagcaggcacccattgaacttcttagatgttctctcctctttgagcatgtaacctttcatctacattctacaaaatagccactttgatcttcctactcaacaatttaaatggatccccactgcctaagaaggaaagcagaaatctcttaccctaatgttctcgtccttccaaaatcacattgcagcctgtcctttagtcttattttccataactccacttcacttggtttgttccattcagaatgtgctttttgtttgtgggcatacttaattaggcttatctgctggtctactctgattattacatagttttgtaatatctaaagctaaaaatggatatatatatatatacttattaaaatgaacttgatacacatgtgtgtgtacatatacatatatatataaatacctttcatcaatacttttgcaaaactttcatttagagacttttagaaacaaattgtgtgtatgtatattatgacaggttggcactgattttaatttcttttaggataatgaacctttctgatttggctgacttgtagtagtggtaaatactacctgttggaaacctgtatttaatctaacagatgctctaaaagtctgtactttctatgcagcatggtctggcagaaaaacacttttggagtcagacagctcaacgcctcagttatgtaaacaagaggtatctacgtagatacatagctagattcctagatagatggtatctattatatcccagatggttttctaggtcagggaatatactggaagatctggatttgaatacagacttcagtttgaatggagcttgacaagtcaattactttcaagtttaagttcctcctctgggaaatagcacaaatagcacacatgacaccacttcataggatgtgctraagagtaactggcttaatgctgttaacctcccaaccttgttcgtatgacagtgctttctgaggctgaaaatctgatcttcccaggtttgaccagttgctctgtttagctaaggtcagcctgtttattatttgggacagtcccaagagaggcaagattagcatcctttgaactgaaaggaacccttctcatctggagggtgaagaaggaagaacagaatgtcctggtggcatttagaatggaatctctagcccttctccttggacactgtttgcgtcatgaaaaaaactgtaatatggagacgctgtctccagcaagaaayttatggctatayttcaatagtttgttcaaatttagaccatgccagcttctatagttgatgaaagcctgaatatccaaacactatctccattaataaaatctcaatgttcccagaatgacgaatgtctgaaaacgggttttattgtgaaaggagaagctcatttggtgtttcctcttctctctttgcttttagaagaaaaaaatgagaaaactctgtagtcagccaaaaggtctttgccccctactaattctttttttaaaactgtcatgagaagataagagttttaaagttttgtattctatctctgggtcagggatcaaatatttgcatttgtaaagaaatcagaattgtctttgagaggtggagattcctggcaatgttcaagctcacaagttgcacaattctgtaatgtgaagtacttctagtcacctcgatgatggagagggtcacagcaaagagatctggccacatgggtggtcaaaagtaggatgtgcttagaaagaagttgtttttctttccattttctattattaagtatttaaaaactgtgatgtagtcacaytgtttctgcattgatactgtgctttcctttctccctcccacagccctcagtaacccagaygtttattcttctatctacctaccttcacttcctatcacccaagggtttctgccttttaggttttctttagactgagatactgtctccctagcctttctgctttccggctggccgttaaaacaatcacccagcccttttctgtattataagtgttaattctgatctcagttgggaaataggcatatgggaaagatacaggcataccttggagatattgcagatttggttccagaccactgcaatagagcaaatattgcaataaagtgagtcacacaaattttttggtttcctggttcatatgatagttatgtttgtaatatagtctattaaatgtgcaatagtagtatgtcttwaaaaagtatgtgcataccttaatttaaaaacagcttatttctttaaaaatgctaacagtcatctgagccttaagtcataatcttttgaaaatattttttcttaaattaaaaaaattaaagtatcttaagtctgcttcttaatttttttttcaaatcctccactatttttttagataggatcttcctctgtcacccaggctggagtgcagtggcacagtcttggtgcattgtagcctctacttcccaggctgaagcaatcctcccacctcagcctcccaagtagctgggccacaggtgtgaaccaccatgcctggcttttgtattttgggtagaaatgacatctcgctatgttgcccaggcttgtctcaaactcctgggctcaagcaatccacctgccttggtctctcaaagtgctgggattataggcgtgcaccaccatgccctgcacaggtcatgatctttttgctggtggaaggtctggccttgatgttgatggttgctggctgatgacagtggtggttgctgaagattggggtggctgtggcaatttcttaaaatgagacagtaatgaagtttgccacgttgatcgattcttcctttcacaaaagatttttcagtagcatgtgatactgtttgatagcattttacctacagtaaaacttctttcaaaatctgagtcaatcctctcaaaccctaatgctgctttatcaactaagttgatggaatattttcaatcctttgttgtcatttcaacactgacaaccagaatatattctatctccagagaccactttctttgctcctccataagaagcaactcttcatccattaaagttttatcatgagattgtagcaatttagctacatcttcaggtgccacttctgactctttctcttgctctttctcccaaatctgcagcaacttcctccactgaagtcttgaacccttcaaagtcatccatgagggttggaatgaacttcttataarctcctattaatgttgatattttggcctcctactatgaatcatggatgttcttaatggcatctagaatggtgaattctttccagaaagttttcaactaactttgccaagatccatcagagaaatcactatctatggcagctctagctttacaaaatatacttattaaataagacttgaaagtcaaaattactccttgatycatgggctgcagaatggatattgggttagcagtcatgaacacaacattaatatccctgtacatgtccatcagagctcttaggcgactaggtacattgtcaatgagcagtaatattttgaaaggaatctttgtttcttagcaggtctcaacaatgggcttaaaatattcagtaagccatgatataaacagatgtgttatccaagctttgttgttccatttatagactacaggcagagtagatctagtataattcttaagggctgtaggatttttggaatggtaaatgagcactggcttctgcttaaagacacaccagccgctttatcccctaacaagagagtcagcctaccctttgaagcttagaagccaggcattcacttttcctctccagctatgaaagtcttaggtggaattttctctctgcacttattggtcagttatgttgtgaaactaacctgctctaaaaataacatttgggccagatgtggtggytcatgcctataatcctagcactttgggaagccgaggcaggtggatagcttgagcttaggagtttgagaccagcctgggcaatatgatgaaaccctgtctctccaaaaaatgcaaaaaattagccgagcatggtggcaggcacctgtagtcccagctactcgggaggctgaggtgggaggatcacttttgagcccaggaaacagaggtcatagtgagccgagatcacaccactgcactctagtcagggcaacagagccagaccctctctctaaataaataaataaataaataaataaatwctttatttaataaatgaagcaaaacaaaaagawcactgatcacagatcaccataacagatataataatgaaaagtttgaaatattgtgaggattaccaagatgtgacacagacaccaagtgagcacatgctgctggagaagaggtgccactatccttgtgtgatacagggctgccacaaaccttcaatttctaaaaaatgtaatgagccagtgaaatgagctgtgcctgtacaggaaggtgctaggatcacgtaacttatactgttactgaaacaccaggggtttggtctaggtcctgctgcccactgcactgaaagtcaatcactgagatgccaatgtgatgtcaatcaatgaaatgtgagcacagtgaaatgagctgctcctgtacaagaaggtgctaggatcatgtaacttatactgttactgaaacacccggggtttggtctaggtcctgctgcccactgcacagaaagtcaatcactgagatgccaagcattgccaaggaagaaggcttttcttgggtgctgcagctgaggagatgggagctcagactcaaatccatctccctgactgactaaaaccacgggtttatatagaagggaaaaaaatagtcacaatgtgtaagaaataggaactagggaggggcaacgaagcagtcatgatgagtgagggatatggcatttggtacagtgatctggtgagtttcacttctttgatacttttttgagaggcctgaaggtcctttcccaagaaaggaactcagataaaataaatataagtttcaagctttaagacaaaaaaggtcaatttctatgtttatccaaaagaacagtctatggaacgatggggttggtttcaatacttccctggcatctgattggtagttctcgtgtcccttctgaaatggaaactataagactccttgaacatttttctctatgtgaccagaccagttcttctgaaaggatgctggtcacacctgccctttcccttcaatatagttctttccagcaagggcaactccaagagctggccctttgcattttcaaggcctcctaggaagtcgtattcatttcagggaatttctggtccacagaagaaaaggtacttcctcacagtgcttaggtaacttcactaactaatgaatctctctgaaagaccagaatgttccattcaatgcagttactaaaatgtatttttcctttaagattattctgctttatatttcccttttgatttctcttgaacataagatgtgataagagactaatttcagtattaattttctgttttaatactttatgatgaaaataattataattcagtacatttaaattttaataaaataacatctagacaataacttagtatcaatttaatatatagttaattataatatattaattaatattaatttgttaatagtttattaagcattaatgaattataaaagcatttaaacaaatgtcttaatattttaaaataatttaagtaaaatattttaaaattgcttactatttataaacatttagatatttaaaattaataatactttagttcctagtttaaatagaaaaatgttcctaaaatatgcataagggaaaaaaaagaaaagaaaaacacactgattatttatttccaaagaacaattaaacaagaagcaactgatgagaagcagaattatttgggatggatatgagccttagcctccatcttctgtagtgtaattttcttatgaatctgttttagcttttccctgaaatcagaaaagctgtgtgtgtgtgtgtgtgtgtgtgtgtgtgtgtgtgtgtgttttgtcaaaggttaagtctttcttttttgatgtgaaagttagaacaattaaaccgatgtaaatcaaattactgttctttgaatagtaagccatccttaccatccttatgctctctgtagttcctgctttttctgttttaatctgtgcattattattaataaaaatcattttcttctataaagataacatatgattagtacagatatattgggaaatattaagaatcaaagaaagaaaatagtaacctgtagtctcccatgcaaagacaacacatatcctttatctgagattttcctgttgtccagacatgtgaatgtcaagagagaatatagaattaatgaatcaaaacagttcctgtgaactcatatagatgttgctttactggaccctgatgtttaacattgttacagaaaagtcgggggtcagtctgattatgctccctttacaggtaacctgtttattttggctgaggtgattgtgtgtctttattcttatagtttattctctgttctctttctttcaccagagtctgttccattaaagaccaagaacgattaccccttgcctttttacagagctaagaatattagaaccatcagtggctcagggtctgtcaagtctccagtgagtcattctaggttgttcgccatacatttctgttcatcttagtttctctctgttcctctcttgattttttgccggacagaatattataaggaatatttattgtttgtgacattagggccatcaaattcttaaataagacttagtcctttctcagaggtagtattatccttttctcccttttgttaaagtgataatacgatcaatgtaatttttaacatttttcaaatatatatcaacttttgaaattagctgcatgtagtaataccagaaaatgtacattcatagaatttgttttgttcttaattctagattttttaagttacagaattaaaatgttaatctgaatcccttttgcatcaataaaggatttttatatcataatttttagaaacttccttcatccttaagttggccttcaaagcatatatatccaatgtcactccatagaaactttggttttacaagtaaatatatagttcatttactttatrtgatatatttgttatgttttgtatttgctgactatatgcattttatgtggaaaagcattttaatttaaaaagtttcattctagaagaaaatcagctgttttaaaagtattttgataactggttatgagccataatagtattattgttgtgaagcattttgtttccctaagtgtaagagtcaaacccaagaaaaatattttaatatgaaaaaatattctaccacacaatgatcagaatatgtacttttattagataatattttgaggtgaccattttggcatgtgttgggttggtactaaaaaatgaaaagatgagcttgcatttctagcataggctaaaattatggagatgatactcttaatgattatatgtctttaatcagaagttttcacccaaagaacacatggcttgaaataagttttttaaaaacatcaccagtgtcaacattatattatacaaattaagaagtaggattttttcctttttttaatgaaacacattacaccaagttgggaagggttaacattgtcctacatataatakaagacagagaatggaccagcaatgtagtcagaaggttgattctagagttccagggatcttagaagtcccaaacataagcagggagaattttggctttagaggtaacatctatcttgtccatagaacttgacgtatttttgtgccataacctttactaatctgatttcttgaaatgttttactttgtttccaaatccattgctacctatggtaaagtttctgacaaagagcatgctcctggattataatagctactgtagaaagcttattacatgtcacgtgtttgaaatacagaaattcatgtggttcttatagcactgctgtaaattaggtattaccatatccttttcacaaatgaagaaactgaacctcagggtattgagccaggacacgcagccagcaagtgcacacactggcatgttctagcccaggtatgttcaccactatctgtctagggaaaataattccatagaacataagagactgaggaaatgtatagagccttttaaatccttacatattactgataagaaaatgcaagccctttaacttttrtggtaaatggtgcaattaaggtgtttatacttatttataaaacatagcaggctgggtgccgtggctcacacctgtaatcccagcactttgggaggccgaggtgggcggatcatgaggtctggagttcgagaccagcctggccaacatggtgaaaccccatctctactaaaaataataataataaaaaattagctgagtgtggtggcacacgcctgtaatcccagctgctgggggaaggtgaaacaggagaatcgcttcaacctgggtgacggaggttgcagtgagccaagatcatgccactgcactccagcctgcgtaatagagcgagaccccttctgcaaaaaaaaaaaaawaataaaaaaaagcaaaggcatattttgttttaaatgcatttcattgtccagtgtacccaaccatccatatatgacctagcacttctcaaggacaaattatcttgccacctatgcagacttggaataggatagcatggtaaactgaggaagaagtgagagcatgttaagttggtggaccatgattggcatcagccaattttcatrtagttcctttagttccaaggatttgttatagttgatctaaaaggatgccgaatgaacagcagtaaataggtgaccctgctttgcttattggtgttccctaccagaggtgggaaagaaatgaataattcctctaagtggaaatggtccrtgctccagtaggtttatgctacatttgaagtgtcttccttctgtcacttcctctcctctctactctggggtttgtgagagcttggagtgtgtcatacaatatcctctttggattgtgaactttcttacagttttcagagcactttgaaagacatctgaatcataagggataacacgggatggatgagaagaattaaaacctgtaataatgtatagaattatcactgggtgtggtccaggttgtctgccagacctacttctccagccactcctatttcaaagatgtggcagttaaggtccaggaatttctggtgatcctgattcctagttaagagtcagaaacatgctccagtctagttctgtctcagaatgaggtagctcctagtctaggactttgccatgaacaacttaatacttttatttatattgagtcatttgatatgcagaatcccaaatagatattgaggacttttgggattatacctctatttatttactatgtctttgagtatacctctttgaatagttttccttttggttgctatctcattacaatacacatgtgacttatcacagtctactgatatcaacattttaccactttgagtgacacatgggggccttatttccatttaaatgcttttacctttcccacttttaaatattattgtcttgagtatcagatggtgttataatgtttaagtcatctaatatatcttatgaaactcatgaggaggatcatctatcgtatgtagccatatttcagcttgttttgttgttttatttcctaatgctccatgattccatcttccatcattttctttctgttcaaaaaacttattttagccatttttaaaaggtctgccagcaacacagtccttttgtttctttcatctgtttctatattcccttcattcttgaagtatagttttcctggatatagaatttgaagatgacaattctttgttttcagcacttggaaaatgcaccttttccttctggcctatatggtttcaggtaagaaatttgctgttattggagttgatgttccctaataggtaatgtgttgttgctctctcagtgctttcaagacttttttttttttttttttttttgcaattcacttatcaaaattttaattatgaaatgtcctggtatggatttctttgggtttatcctgtttgagatttatacagcttatgaatctgtagatttatatttttttgccaaatttagaaaattttaagccattattttaaaaacaatttttcaagcccactctctttttctccctctattctggacctttgatgatgtgaatcttgaacattttgttattgtgctacaagtccttgagggtctgttttttgtcggtttttagtctattttcttcttgttcatagtgagtaaatttggtaattctgttgatctgttctcaggttcactgattctgtcctttgtcaccttcattttactattgaacccgctaagtttatatttgttgtactttttagttttataatttccatttggttctttttttaatttctcaaaaaatacggaatgcgtcacgactttgcatgtcacccttgtgcaggggccatgctaatcttatctatgctgttccaatgttagtgtatttgctgctgaactgtgagcaccgtggttctttttttaataacttctagttcttggctgagattttctattttttcatttgtttctaaataatttacagttactcattacaccattttgaggatggctgctttaaaatctttgtcaataagttcttcttctgtttcatctctgggttagtgtcagttgtcatttcacagtcaagttgtgattttcctgayttttggtttgttgggtaatttttcattctatcctggaatttggctatgctgttaggagactcagagtctgatttaaatcttttgttttagtaggcagtcatcccatttargtttagcaagaaaatcctggcctaattttgtgggccgtgcatccaatgacaattrcattttcagagactttgtggtgctattttggtcttcttggtttatctggggctgctagggttcctcctggcgtctgctggtgctacctgaaggggtggagctcttcagtagagcctcatgatgcctctgatggaggtagagggaatacaaacagatatcctggagacaggcactagtgctgaggactgcccctctctccaaggaaaacacttcccaggtggagcctttttttgtggcaggatcccctttgctagtgctgcaagycacctgctgtttctcattggaggaagggagtcttaggcttggtgagtaaggagagtgctttcctgtcttcttatggtcagcaggtgtattagtctcatgctgctaataaagacatacctgagactgggtaatttataaaggaaagaggtttaattgactcccagttccacatggcttggaaggcctcaggaaacttaacaatcatagtggaaggggaagcaaacacgtccttcttcacaaggcagcaggagagagaagtgctgagcaaagtgggaaaagccccttataaacccatcagatgtcgtgataacttactatcacaagaacagcatgagggtatccacccccatgattcaataacctcccaccaggtccctcacaacgcgggattatgggaactacaattcaagatgagatttgggtggggacacagccaaacaatatcagcatggctcctgctccattttccctggctagtaccgctggccagcctggtagtatcattgggactcccctttggtctgagtgggaatgagcctatttgggctggctacgagattgaggctctagaaacactgggcttgggtgaccttctgtgaggttgtgggttgtaagacactgtcactgtgacattcctctggttgtagggtctctaaccatttcaccttttggagttctctggcttccttttgtgttttttttctagggtttatatttatacttagctgggagaaacagggaaaaagtatctgtaccatcttgtccagtccagaattcttgtgcagggactatttttgggtagagttggggtcggagaagacccttaagactactcattatagaaaaaatgaatttagttagtggctttgtttcagtagaaagttctctatttttctacctttcatagttccctgtaaacaaaactgaaatgcagtctacctgccctctctcttccccctacttcgtaatcatgctgtgatatggtttggctgtgtccccacccaaatctcatcttgaattgtagctgccacaattcccacatgtcatgagaggtacctggtgggaggtaattgaatcatggaggtgggtctttcccatgctgttctcatgatagtgaataagtctcacgagatctgttggttttataaagggcaattcccctgcacacactctctcttgcctgctgcatgtaagacataccttgctcttccaccatggttgtgaggcctccctaactatatggaactgtgagtccattaaacctgtttcctttataaattacccagtctcaggtatgtctttattagcagcatgagaacagactaatacatgctgcctctatgggcttcaatgagctgaagttcttacatctttaggaacgtggaggaagagttaaagcctcaccttcagttttgctactcttgtcgtagtgggaacgtgagtcaacaaatactctatctttaggccacgacttctccttctgccttcttcctaatcgcctcttgtcaacttcaccaagcttaacttcacaggctgggaaaaatgagcttttaaagacagttagtcaaatcttatatgtcaaactcaaaaagggaaagaaactgtaagtgtaaatgccatctggctttatttactcatccgcccccatctcagaatcactttgagcagatgcatgctttcactctgaagagcagtttataggaacagattgaagaaaagatttgttttaaacatttcagcacgataattagattcaattaaatttgtcactaagtattctgtaacttaagatgccctagcccttggcacatatgagcaaaaatctaaaaaacacagggaaggtgctgatgaaggttttggatgagggttcaagtagccaaatactaccttcacttttgagataaatctaaaagaaaatttttaaggtagtaaatataactctgtaaaatacaaatagaattcttaaatttcaggaaacacccaaagattcagaaatgaatcatatttcctcatttgttgggcatttaaaatgtaattttatactagtgatagcaacagggtcaagaaagcttgggaatggtgccagaaactgtaacattaaaagtagaaaaacttggttcttccttagatgaatttatgtgtgactagaaatgctatgaaatgttctcaggtaggaaagtacttgcggcacagaagaaaatccctgttctctaggattttgggggagaaactttatcttaaattattctaggtatgaaatcatttacaaatgtaatttttattttaacatggtgggagtgagaaatacrgaccactaaagatgctcacatccttatccctggaacaaaaagatacttttcagatgtgactaagttaaaggccttgagatagggaggttttatgctggatcattggctttgaagaaagaggaagggtccatgagcagtggaagcttctggaagctggaaaagtcaaggaaactgattcttccctggatcctgaagaaagaattacagccctgctaacactttgatttttgcctagcaaggactcacatcagatttctgacctctagaattataagataataaatttggattattctgagtcacaaagttttgtgataatttgttacagcagaaatagaaaacgaatacaaataagtgagttatttttaagagggttgctatttgtctcatataactttttatgtaaaagcattatctacaccactgactttgcccctaggaaaacatttggcaatgtttggagacatttttgattttcaccatgggggcatgggggtggtgtattactggcactgagtgggcaaaagccaggggtgctgctaaatatcttacaatggaatgaccagtcccacaagaaagaatcatctagccaaaatagagaaattctgagctaggttaatttatgtactcaaagcatactcttgctacccaaagtgctgtacatggatgagtaacattagcattacctgacagctgttagaaatgctgattctcaggtcccactccagacctactgaatcagaatctgtattttaatagatctctgggtgattcgtgtacacattgaagttgataaagcactggtctaggtgactttctcttgctttcttcctctccctatcatttcctttctcctcccttgctactccctgcacttacggttcccatttagctacgtaaatgcctttcttcccagcttcagtttctagtctcctcaagccaggtctgtgtattatttcatctctatattctcccaaagacactgactacattgcattgcacaaaatagctgcttgatattatttatggatcgaatgaacttctgaaaattcttgatgtagataattttcattttaactgaatggatggctgccatcatttttactttgtaattgaattcaaacatttcctagagtgtcaactatgaaaaaagatagccatttcaaatacctagaaatttcatagtaaattgaagcttcctaatgatttcacagtgtgaagaagagaactcatcctaartatcctatattctgattcttgatgtgtaacaaaatgtagccagtatttccattcttaacattccattcttaacattaattctccagagcaatcatttgtgtaatggaataatttgtgttgtatttttaaaaaagaattagccgatgtttgtccaaggaacctaaggggattatcaggtttttggtatttatcaaaatctgttactttatatgatggttacaactacaaggaattatctcattttttttctttgcacgaatgcagtgaaaacactcataggatgttttggagttaaggtgacacacattacgtgaaaggcctgattttatgaatactgcatcttacagcaaaaataagaattcactgctacagaaaaggagcaaattaaaaattctagtttagttagccagagatttctcaggctgtaagtgatctccttcattttgtagatgaggaatttgaggcctagagaagttggtgctagtcaaaagatcaaaccgttgcatgttttgtggaaaggacaatattggaggcttgcttttaaacatagctgtcttcatctcgtgaacgtgtgctgtaaacccgatgacccttgagggccttgcaacttttgaaacattttaaatccggttctcccactctaaatatagcgttcttatagtttcatactgactctctgtagactatttctgtctggagaaaaggatgggtaggtggatggaagctgtcactacaatactagtacaaaagttagatttaaattcatgtttctttgcacacggtaatctacataaaaaagtttttacttcatatgtagatgaataaaagtgccaagttatattaattctctgataaaatagttttgtaattccaaagctactgggaaaagtccaacagacacatattttttaaatttctaaaagcaaaactagcactggaaaaaataacttggtccagaaatattggtttgtattgcttggaattgtaagcattgtgttgttttaaggtcctttttacccttcaggatagagccatggctttcactggattcccagaggcaccaatgtcacagaaatgagtcactagttttctcagctcttgaaatacgtatctgaagaccagtgaaaatctgacttgtcaagactatgattctaattactagggtttcttgagctcactgtttttgctattaaatattttcttccttcctccagaaattctgtgtttgaggattttatgtatcccttgtgaaataatccccarataatgaaaattcaacaatacaaagtgatgcagagacaatgatccttgacaacagtagtatagatatctgctcattaaaaaaaaaaatcaaaggccttattttagtctatatctagttatttttttctacttttcaatgtttctccctatctttctagaattagttctccagttgtctttttccttttaccttatgttgttttatcttcaaagacagagtgatggagcttagtaaggatgctatgatttgaagaacacagatgcctctaacttatggaagaggaagccaaatgctgttccacattcagataaacagatgaatggatgcaaaagtttctccctataagatgtgtttgtagttctgatgcataagaacttttccagcatgctaagggggttgaaaggtactgtattagtttgttttcacactgctgataaagacatacccgagactgrgcaatttacaaaagaaagaggtttattggacttatggttcaacatggctgggaggccacacaatcgtggaggaaggcaaggaggagcaagtcacatcttacatggatggcggcaggcaaagagagagcttgtgcagagaaactcctgtttttaaatcagatctcatgagacccatttgctatcatgagaacagcacgggcaagaccctcccccatgattcagtcatctcccatggggtcccttccgcaacacatgggaattatgggagctrcaagatgagatttagatgggaacatagagccaaactatgtcaggtaggaaggcaggattcaggaaaataaaattctctgtctgattaaagagttcactaaatcacgcctgtaatctcagcactttgggaggccgaggtgggcagatcatgaggtcaggagatcgagaccatcctggctaacacggtgaaaccccatctctactaaaaatacaaaaaattagccaggcgtggtggcaggcgcctgtagtcccagctactcgggaggctgaggcaggagaatggcatgaacctgggaggcggagcttgcagtgagctgagatcacgccactgcactccagcctgggcaacagagcaagactccatctcaaaaaaaaaaaaaaaaaagatttcactaaatagttgcatattcaaatacaagtcacttaactcaccccctcccaaattttaagtcatgcttcagtgtattatgtgtttattacaagttcatacggtgcttaaatcctagtcttcaatctagtaacctcactatgggtaatccttagtgtactattcttgtggatcctttcctttgtttttcttgcctacttaagtgtagggttactttctagatcataccatggagtagtacaatggggaatgtcttaaaaatcaaatacttaagtgcaaaacacaaaataaggtgtaattcagtaacaatcagactaagcaaataaaaaacattctgagttgccttttaaatgtttcaagtgtgggttgcccctgataaatttaattaggcatcataaagagataacatataaatgcatttaaaagatgtaattgcacctcaaaactttacatagttaaaaatcaaaaggccacaaatgacctgaataaatagcaggagtctgaaaaataactgtcaaaaagaaaattgtcagcaatgtttttgaaaatataatgagggccctagaaagtacgcagcatagtcaaaaatctgtcgtggtaacaagaataattatgagcaggacttgaggttcttcattagcatcatatacctggattaaatggagcaagtacatttctccctctgatctaaactggaagcgagcactttactggtttacagctaaaggaagacaaaggaattgacccagcttacatcttccctaactaagtttttcactctgtaagcctgatctgattaagatttttgactaagaaatgaatacgaaatggatgggtaaatggcatgagaagcaagagaaatgcccaggtgtcccaaaggctgtctttccattcttcacgtggggccaacatgaagctcctctgggctgcatctggttctcttttgttgctactttatttcttaggaaaattatttttattgttttttagccagaactgttctgcaatgaaattctctcagcgctggcctttgcccagctgcccagctgtttctggagggtggggtccaatcttaccgaggtggccagagtgcatccagctccgaacaccccccagtcagtgctgttgtctgataagtctccaacagaccctcctgaactgtgacctgtgaaaaatagaaatatgaggcctgtgtgttcactccctaaagagttccctccctggcttatctattttcctcaaacatctcaactaggtcaggccctgtcattaaaaaacaagtggrtctcccctagtttcccrgctaagaagatctggcctctgccttaggccctgactagggggccccgtgctgcaataactggttgtgcagcccacccagcctagtggccaggccccagtgtctgccccagagaggagaggttggagccagccacccagaacctttgctggctatgcctggctgtagcagctgttctggctatgcaactctgagcatgctcagagtggggcgtccagtacaccctgtcttcccaggctctctaaagccagaaggatttcattcttttccagaatgtggtactttagcaggctgagatagtccattcctcttagaaattgttcccctctacttgaaggatagtaaaataaaggaccatttaaacttttaaacttgactcttacctcaaattctttttcaaatgagattgggtctaaaattaagaaattaaaagcaaatattcattttatattctttttttattttttaagactaggtcttgctttgtcatccaggctggagtgcggtggtgcaatcataactcactgcagcctttacctcctgggctcaagcaattcccccacctcggcctcccatgtcgttgggacatgtgtgcaccactgcatctggctgattttttttttttactttttctggaggtagggtttcagctcgttgcccaggctggtgttgaactcctgggctcaagcgatcctcctgcctcagcctcccaaaaggctgggattataggtgtgagccactgcacctgtcccttatttttaattttaagcaaaaagrggactgactctgaagttcaagaagtcatcaagaaatgctgatgggttacttcagaattgtttcagattaaaggacagcctggtgtcactctgtgactatggtaatggcatagtagggaatacwgcttcccactttgctatctctaggttaggagaaccaataacagttcacccaaaatatccacatttcttggaggcttatcctttgcgtattcactgaagaaggaaaggaaagaaatgaagggaacccattaggtggccctgtgcttcgtattccatttgcagtgtctcattcagtcctcacaatagtgctgaaagtagatcatatcctcatttgacagataaggatattgaggctgggcaaaagtgaataacttgtccaatgtcccatatgcagtaaggaaaagaaacagtatctgacctcaggtctgtctgtctctttcctcctataaaagatgaatacatacctttaaagtcctccaagttacccagcctcggagattaaaataaattttatttccaagatatctctatttttcttcctccccrctaactagcttcttaagttcccatgtgaatattgtcattcatttccttaattattaaacatgttttgttttaaactggtaaataatgtttaataaaggttttattattattttaaaaacatttttaatgaagttctttccattgaagcatttctaatttattctaatgaagcatttccaaagaataaagaaaagtaataatttagggttggttatctacatcaatatcattatcaaagtctactgtctgtccttcctcttttttcctccgtcttagaccagggagcatagtagatgaacatcatgcaggccagcacactgaggcyacgtgtaagcaggtgggaagattatgtgcatgaaacagacagtcgcataccacttttggttacaaacacttgccctggatgagagcaggaattgagaccacgtttgtgtcccagtgggttccaggactttttttccatcagtttccaccctgtcctggacaggcttagaaaaacatgtttcttaccaaaaaaagttacaaaaacaatgtttacattaaaattcaaagtccatgcaactgcctctggttcctcaaggtaactactgccaatgatttggtgtgtatccttctagacattttttgtaatgcacatagggtatatatacatataagtacctatagcaattttataagtgacctgttgtacatgaggtaactttatagacttaatgtaatgtgcgtatcttcccatgtgggtaaatatgatagagcagtgccaatctgcttaatggctgcttactactccacttatgtatactatcagtggatattgagatagtttctaattttctaccgttataaatatttcattgaacattatgtggttgtatttttatatgcttcttcaagtatatctggatgacacatttctaaaatggaattgttaggtaaaagaggacattgtacatttagatagatattgccaaattgcccttcaaaaagatggtcaaatgactcttctatcaacagtatatgagtgtgtccatttatttattaccattatgtcactagtaagagcattttaaatctttcccactgtgctacctattctttttaagatcagaataacacatttaatactgatgagctttagttctgaagccaaagcgcttgctaacatttcatccctggatcaacagactcaaccacccagccacagatattgctggacaatcatgggtttccccagtaagggtgcagcctgcaccactaagcttattgagtgtttttgagcctgcctgcctgcgtgcctgcctgcctgcctgcctgcctgcctgcctgcctgcctgcctgccttccttccttccttccttccttccttccttccttccttccttccttccttccttcccttcctccccttcctccctccctcttccttccctttccctttcccttcccctttcccttcctttcccttcccctcccctcccttccccctctctctctctttctttctttctttctcactctgtcaaccaggctggagtgcagtggcatgatctcagctgagtgtaacctctgcctcccaaaatcaagcgattctcctgcctcagcctcctgagcagctgggattacaggcacacgccacctcgcctggctaatttttgtatttttagtagagatggggtttcaccatgttggtcaggctggtctcaaactcctgacctcgtgatccacctgcctcggcctcccaaagtgcttggattataggcatgagccaccgtgccggcctgagctatgacctactttctacaggaaactagaagaagaaactaaagatagttggtgctggcctttctagtgttggtcaacctcttcctcattctctctctctgtcattctctctttcctactttattgaactataattgacatataacatgttgttgcatatattgatagtttgtttctattacagactagtattccattgattggaaatactactgtatattcacctgttgatttgtggatggacttttgggttgtttctagttactgactattacaaatattttgctctgggcatttcctacacatctttgtgtggacatattctttcctttctcttggataaatattgagtagaatggctgagtcatatgatatgtgaatgtttaacttttgaggaagctgccaaactgttttccaaataattaataccatgttacattttcaccagcagtgatgaaagtttcagttccactatatccaagtcaacatttgctagggtcactcttctaaattgtagacattcagtgggtgtgcagtcgtatctcattgtggatttaatttgcatttccctgatgactagtgaagctgatcgccttttcatgtgcttaatgcgccatttatacattttcttttgagaagcatctattaaactattttacattttaattggattattcattttattattgtactgatatgtaatgggaatctgacttttatatccctccctcaccccaaagtcaaattattccaagactatttattgagcatttgatcttttcttcatgttttaaaatatgtgttagattttgttatgcagagatccgtttttagattttaatgtgtgccactaatctcgtttatcctcctgctagtaccaaactagcttaaacctgtgactttatagcatgttttaatgagataatcccctttcattaacttgcccccacaaatgcgtttaatatacaaactaattttgaaagaattcctattttaaaagtattgaatcttccccttcaagaatatggtactagttccatttatttaggtattttttcttaaaagttatgtaatgttctttattgaagaataacatacttttgctagatgatgattatcttgcaaatatttattataagaaatccatttagttttgtactttaatttatatatgcccacttttctgagttacaaatttttttctaatagttgattgaatagttatcaggtattttagtttttctattaacaagcaggcaatctgaggacaacttattttcaattgtttatcacttttttcttttccagcttaattcattgactagaatgtcagtacaaatggatatccttttcttatcccttatattagtggaatacttctagtatatcgttgttaaataagatttctgttggtttctaataagttttctgtagttttccccattcccagattactaagtgttgtacttgtaattatattttgatttgttggtggtggtgttttatcttccttttaaaaaagtaaatgttgaattttaccaggcaagtcattggtgctaatattttttcttaatagtgtggtgaattgcattaagagatttcctagtgttaaccctttttggttggatcatagcattctgctaatataatgtcagattcaattatattcataaagttgactggtctatacagttattctcaaagaaaggtggtacttcctgctgactattctccagggacatttgggaatgtgagggagtagtttttgctggccacaatgggcagggtgctaaggaccctggaattcatggaacagttaatgcaacaaagaagcttttcatccccaaagccaattccaatcccactgagaaaaactaatctgtagttttgtgggggggagatttgttttgtctatttttttatagtttattttagtctcttagaatgaattggaattttttttaaatgttaatacttggggaacaatataaattccataggaagtaatatgttccttagtggtttgataaatttcatccacaaatccatctgaatctggtgccttttgaggggggtgaaggaacttttttaacgattatattctctatgttttttgttttgggtatattcagattatcaaactattacatcaattgtcatagtttgtttccttagaaaaacatcaattttagccattttttcaaatttattggcaaataatttcatgtaacttcttctagttgtgtgaacttcatcatctatggttatctcttcttcgtaatctgtttttattttgttggtcatatttataagacatttgtctctttagttgtttctttaaataccagatttgttgtcttaatcaagtttattcttttttatttactatttcagtaacatgttttaatttcttttttgcttttggggacgttatatatttttgctcaacttcttgagttaaatgcatggttcatttctttctcattatttgtattcatttgtaaaaatattttggcctctgaatgcaaaactgtgctgttaatggatttctagtctgttagatattccatttggatataacacaatcacttaattagggtatgtgatttgtattactagaaccaatagtgattattttgtaaccacaatatgctatttgtacagcaaacaagcctaaagctgctttgaatttccagcagctcagctggtatcctgttgttattaacagttgtaaactcaattacaattttacaattaattttaaagtaatgatttgtgacaaaaattctagtagtgaaaaatacacagtgaatctaccttctcacctcaatctttagccatggcaatactaatttctgatttagaattttttaaaattatctacatatataagcataagtgagtgtgggagggcatgtgtgtatctacatatacacactgagtatatgcacctattcttacctgacttttcttttcaccaacttaatgtggttttttctttctttatttatttttttattttttgagacagagtcttactctgttgcccaggctggagtgcagtggtacaatctcggctcactgcaagctccgcctcccggcttcacaccattctcctgcctcagcctcccgagtagctgagactacaggcgcccaaccatgcctggctaatttttgtatttttagtagagacagggtttcaccttgttagccaggatggtctcgatctcctgacctcgtgatctgcccgcctcggcctcccaaagtgctgggattacaggygagagccactgcacccggccaatgtgttaacaatagttttgtaaaacatactaattcatgcccatagccacttttctattctcttccagtgaaactgcttcaaagagttgtatatccttgcagtattcagtttctttcctgctctctcgatgttactccaagtcaggagttctcatgactccactgaactgtcatcagtgtcctccttgccactaaatwcattttttcagttttcaggtattttttacttttctcattctctccagtatccagtctgttagccatacatatcagctgtatggtcaaaatgtgtctatgatctccaccttcccrtattcaaagccaccattatctcttgtctgatttactgcgtgagtttctagctgctcttcttgtatccacacttgctcttccasagtctccaaatattattcccctctaaaatgtatcttacttattttgtattttgttgattgtctttctcatttatcttagaacctaaactcaatgaaggcagattttttttttttttttctgctgggttcattgctgcatccctagtcacataactaatgaaataattacattgtctaataaaataagtacaaaaagaagacatcgtttctatgaaaattaggtgaatgctttgttaacattcaattaatgtaaattgggggaaaaaaagaactgatgaaaacaactgtcgaagtttggagaatccataaaaacactccacagggtttttcactgaaatggctttgcaagaattttaagttctgactctattctggaggagccaaattggaagtagtatgggatgcttaattggggttgcttttgcttcgaatatgacacagaactccagtcaatgcacctgtgttcaaataaaaagccttgactctatgtcaaaacattggtaaatgaatacaaatttatatttttaaataagatgtttaaagtatcatttttatgatttgttgttctaaacactgttagaggcattgaattttatcctccattaaggcttactgtagggcatctgatgacttggtatcagtaaagccagaatacctaaactgatggaattgaataggattctactttatgggtgcagtgtaccttattttacttctctatttatgcttatttaagttatttacagcttttaaaataaagaatactgcaaatctttgcacatgcataattgtattgtgtgtaaatatatctrtaggataagtttctatcagcgatattgttgcagtttatttagacagctttagaactgattgacttttgcttaggatttacgggctagtcagaatttgctttgcaatatttagacttggtgttgtcaattttatcagctagcttttttactctacacttgtacttaaaataattgaaatttatgtagaaaaaagtatgtttatgattgtgaatctggaattctgtagccgaagcacccacttcccaattgaataattgtttttataaccttactttaaggatttttttaatttagaaaaagtttttgataaagagagatatcttagacacatagctatcatattagaacagaccgtacctcctttctgctctgccaagaatctgtgcttcctaaagatcaatccagggcatttggcagctataggagatgtaactaatctcaaaaagaatgacagtgaccacatttacagtttatactgttcttcttttcatgtcttttggctattaaaaattatatttatataaatataaacatttttaggttatgtaaataattcacaaagttttctgaattcgcttttagattaaatttttaatattttccccattttgatagtaagaaaatgaattgtaaataaaatttccattacgtttctctatccttgaagtttctgtcttgggtaatacatatcttgtgattcatgaactgcaaagaaaaaaaatccacaggattttgtcatcagctacattctatgagcattttcagccagatttcagtacttgtttagatttatattattttgggagaatcttaatttgtagttaaaaaattaaatatgttgcaaaaccaattataaacttcctgttaatgttgaacttttgctagggaaagattctaaggggaatttcctttatccttttaaagggataaatattattcaaatcaccttagtaacagttggaccacagtcatgcaattagtttagtatcactttctaagttagatgatgttggtctggagttgacaacattgattttctgtgaagtttacaatttattattttttaaataagggggaaattttgctttttaaaacttttgcaatttatcacttagtttacgaggcaaaatagatttcaccattttgagaactgtgagttattttctatgtgaagaatatatgtggtaccattgtttttgattgggtctcatagtgcacattatgtaaaagaaaacaaatcttactgtcttttttatgatacagcaaagtgaagactgaggatcctgagtgtgcatagtgcatgcatgttatgygttatatgtgtatgcatacatatgkgtatatatatagttttacaagtttaaaataatatcagtgacttgaaaattgtaagggcttaccagataatctctttgtaggccttggagtagcattgtttttttttttttttttcctttggttattgatgggtaataatgctctggtaaatcagtctttttttttttttttgagatggagtttygctcttgttgcccaggctggagtgcaatggtgcaatctttgytcactgcaacctctgtctcccgggttcaagtgattcttctgcctcagcctcctgagtggctgggattacaggcatgtgtcaccacgcccagctaaattttttttttttttgagatggatttttgctcttgttgctcaggctggagtgcaatggtgcaatcttggctcactgcaacctctacctctcaggttcaagcaattctcctgccgtagactccggagtggctgagattacaggcacccgccatcacacccgactaatttttgtggttttagtagagacagggtaataccatgttggtcaggctggtcttgaactcctgacctcaggcaatccacccgcctcagcctcccaaagtgctgggattacaggcatgagccaccacgcccagcctaattttgtatttttagtagagatggggttttatcatgttggtcaggctggtctcgaacccctcacctcaggtgatccatccgcctcagcctcccaaagtgttgggattataggcatgatccaccacgcccggcctggtaagtcagtcttaaccttagttacttcaccctaagacagagctgggtagaaatcagaagacaagaattaggaaaaaaggaagaggcagtgacccatcttaaggtttagactgtattgtttgattgcgagtaaattaaagcctttccttttttgtatgcttatagacctcaggggtcacattctgttcctgagaatagtagctaccattggcaatgaagtatgtgtgcatacatcctggatctaattaggtggttgtgctgcttccatatttttggaacattattctgactttatttgttctatttgtagataagaacattcagaggaacacatctctccccatgtaattatctcatttagcattttgcctactcagagggcatggctaaatgttttaggtacagggaaaagctgactttggtggcagttctttatactgtcttctcaaattaagagggtcctctattcaggaatgtttcctgcataacgaatagacattccttgaagcatgatgaccccccacccactgcatttgaatgtagagcaacatcttacatggaaacagtgatagtataggaaacacaaaataacgtcaaataaactctaattaatagcttcacaaattcaagaagacactgtattgactaaattagtacatattactatgcaaaagtatcattcagagaacagtgttcctgaaaataaaaaaatctgatcgcctgccctcctttatccattactaataaacagacaaaccaaaagccactaccaagtagtgaaatggatakagctaaaaatcaaatatttgaccttgaaaataagtccacgatatcacccaggataccaaataaaaagtaaagtgttaaaaatacaaatgaaaaattaagagacgtcaaggatccatcaatttttaaatgtagattcccaaatatccaacattcattgtaaaagaagtctcagatgaacagaaacaatggaaagaaaattactcaaagtaataggatatttccttaatctaaagacgaatgtgagactatagataaaattgccaatcaagggccaagcaagaattatgagcaaagccaagacattatattctagtgatatctgtgatctcccaaagttaatgaaagacattgtgacagtttcaggtaggagaggatgagaaaaatatttggttaatggcctaggttggtagctagctagccagatccttgttctttctttcacttattttttttattcattcaacaaatgtttatagagcacttactatrtgccaaaaattttgttaggtaataatagacacagtggagtaaaaatagtctgatgacagaagtaaacaataatcacattataaataaaaataaattacacctgtgataacttctaccatggagtgttttatagtgctgasagcatattacaaagggatttttgacttaatcagggaaggcatcccagaagtagcggtaagtaaagtgtgagtaggaattagattgcgaggagagcaggtaacatcccaggaagagagagcaaacacgtacaaaggcccatggttagggggattgtgatagactgaaaggaatggaaaaactaatatgtccagaaagcagacatgcagtgcaagacaaagcttggcgagtaagtaaggactcgtactatgcaggtgttttacacaaaaagaatgggaatcatacatcagacttctcacctgcaagactaaatactagaagacagtgttctgagagaaaatgattttaagcttatgcaaactttctagaaagaatgctcatggatacactctagaaaatgggggtgggggagggagaagaaaagagattccaaaaaaaagatgtacgttagaagaaacaatgtgccacctaggtatgtaaaataagcagccctcagtggaagctgagaagcaggcctagaaatcaatgggttcgattgggttagtaagtcagcgggctgcaggaaatgtctttggggataaattgtataattaaaaagttggaaatacatctgtggcatgcttctgctgtaataaactgtgtgtttcttatctgtaacaaaagagagaataaaaagaaaaagcagttagaagttcaagggaaaacaaaaatctgttcaaaagtcatggtgttgaatctgttttttagtaagagaattaagggcatcacatttatgatatctagtcacatgtttgggcttattcttgacattctatttacgtgtgtgcatttccttgcttttgcttctgtcttttcttttccttccttttgataaattgagttttcttttcaaactgttttgttcttccttcctttttaaaaaatttttstttgtttctttagtggtttgagtggtacatccaatatctatttttaatagtggctaactttaaattttaaaaacgtactttaaaaaattcaagatataggccgggcacggtggctcatggctatattcttagcactttgggaggcgaaggtgggcagaacacctgaggtcagcaattcaagaccagcctggccaacatggtgaaagcccaactctactaaaaatacaaaaattaggcatggtggcgtgcacctgtaatcccagctattcaggagactgaggcaagggaatcgcttgaatctgggaggcagtggttgcagtgagccaagatcatgccactgcactccagcctggatgacagagtgagactcagtctcaagtaaaataaaataaaattcaagatacaattcggtttctacagtagcccccaaacaagacaaaacttttagcaaactttctactcttctgcctcctcttcttaccttttacttaagaaaaatcaagacttctagtttcttgttgttaaaatttctaaatttataaatatctgaatatgagtgagttgaatatataaaaagcacaaaaagtaatacggcaatcatctaatgaccaaacattaaaatcaaacatgctaacattttacataatttgcttcaggtctctgaaaagaattgtagatataaccaaagcaccgtcccctactccttcctcctgcctgtcatctcagaagttgtccggaaattgctgctgcttgttctcattcatgtgcttgcacttttattatrtatctgtgcactcatttaaaaaaccctcacacttaaaaataatttggccaggtaatacaggttaaaattataggatacaaattctgaaccttcaaaagtgtgtaggaattgttccaccattctagaatttggtcttccagggtcttccttatgcccctttgaatgtcctatagcatccatttaaagaccttacacacggtagatgttaatgtttattttccacccgtaatttaatgacatttctacttattaatttttcttgtttgggatatatgtactaggcgcttagctatgacttgctaattcatccaatggaagatactgagtgtctgctgtcgccaggcaatattctagattccagagatacagacatgaaagaggtagcattccttccttcatgaagttaatattcttgttgagggaagataaaacaataaacatgtaaaccaataaatacaataattttgggtataaataaaggatatatcatttgggtatatcagcatgtgatgataataaaatgggagaatgtggtgatggtggtgggctgttgctctggctaggataaccaaggatagcctttttaagaaagcgacatttaataagtaaatagacataaaaagctgcagagagagtaatcccagcagatggatctataaatgcaaagatcctgagacagaaatgggcttggtctgtgtgactggaacctcgtaaatgaggagcgagtggaaagagatgagatccaagaaactagcagggccagtcatgtgtagggcattatggatagcagtaaggatttcaagtaggaagactttggagggttttaagcaggagagtgacttagtgcaaattgatttatgcttgttttgtacaagctggactttagggaagcagtgtggaggaagaggaattggttaagagcctgttgcarttggcagataaaaggtattgctcacttggctaggatggtagcagtggagaagtggttttacctggcttttcagcacctgaatggtctgtaagaatggcactagcatacaagtcatttcaatgtggactttccaaggtacagttgcaggatgagagttagagtctgttgtasggtatggaacttgtacgtgcgcaatacacactacttaatgttaaggagagtacaccagagggaaggcagctttggcattctcttgggcacaggaaagtagcattgtggtgatcaggagagtctaatgaagctaaaactgtcacccaggaatgttaaaaagagaacataatgagtattctgctctgctttagagctctgtatggtgttattatccttctctaaaagataaatgttgctctcaagagtgagtaatgaaaatactagagcacatcatacaataaatgaaatcatgaaactttaaatgtatgcaacatgtgctgtgaccaggaaggaatggcagtgttgaacaccaaactagatggagtaaaattggtatcagggtggaaataatatagaacaataatactgtggagatacctcaggtaaattatrtagtttcaatagtcaggaaaaaagattttttaattaatctgggttattcttttagaaaaagcgttaatctcaaaaagccatccacatacacccccattataatgaacccttagctgcaagactggggaagaataagctttgcatctgtggccactttttctgacataggctctgttaagatacatagcattgaaggatttcctagctaactatgtagtatgtgtgtaccttaatagcagaaatcacaacgtaactacagagatgaactaaaatttgattagattctgggataccatgctgcctgacctgagggaataaacaatttagggaaaacagaaaaagcaacttaggcactcatttattttctcccttgattcccaccgcaggtctctgagatgggactgtttctgggatcctcatttgaaaaacaagaagagtgaggccaccttgggcacagtgctgttgtagaattgatttaccttgacttgttttggatctatgggatgtctggttcttttgtaaaaacacaactttgccagccagactagaaacgctttctgtgtttttcatcaaaaatcttggacactgtctctagaggtcttctctggcaaggactgttttcctctttaactttggttcttgcattccatatgtaagcaaagttcaactagttaggaaaaagtcattctagaaaaaaagactgtaattgtgagaccagatggtaagcattattcagctgatgaggttgggtagatttgagggaaggtgtggtaatatgatctcgatctgcagctgtgacctgttgttccaaaacagcctcattcctccctgccttttgcgtctgcattccagcacctctccctccatctttgtgggcattggggttctcacagattgctttgacagatgcatcagggaggaataaagcttgttcaaggaagaacaacccacggatctgttttgaatatcctccaccccatgttacttgtaatattggcaaatcaggggacaatataaccacttttgttcagcatgctgtgagacagtttcccatgacacaaattgccatgagcctatttagatgtaattaaggcatttccattagatgtcttgcaggtacctcaaactaaacacatactgaacccagctcatcagctgtcttcttctccttacctcccttacaaaacaccagtaaacattttctcctgtgtttcctccttcaaccaaagtgaaaatttagaagtcattctagacttctctgtctcatccatctcatggagtccgtctcctaaatacttctccagtccttctatatctcttcccagtgctgctgtcctgattctggctttcattatctctcttctggaatttggaaatagttttgcctttactttattttcttcttccactctgtcaccaatgttgtgtcttaaatgaaaatctgaccagtaaggccaatgagattacaatcccatagtgggaggtgtgggtgaaggtctttattttttaaagaagctctgcagactattgtaatgtgtggctagggttgagaatgtatgctggactggacaaatttcaaatagccagatatacaagacctttgtgaccttggwcatcttatcttctgctacttctgtttctgatgttacaataaataaccacacttcttcwtcctttttttttttttttttttttttttttgagatggagtcttgctctgtcactcaggctggagtgtggtggtgtgagcttggctcactgcaacctctgcctcctgggttcaagtgattctcctgcctcagcctcccaagtagctgggaccacaggtgtgcgccaccacgcctggctaatttttgtatttttagtagagatgcggtttcaccgttgttggccaggctggtctcaaactcctgacctcaggtgatccacccacctcggcctcccaaagtgctaggattacaggcgtgagctcccgcaccgggcccttcctcttactttcatactgttgcataccattcatcggtgttgtgcctgggtttgtgggattcttctatcagaaatgtgctggaaatatacaaactactcaaagcactatgactactgagtactatatttcattccccatcttggtaggtgatggcattgacccatgagaacctccaaaatgatttgcttccctatgttgtctctctattccctcttgttatcttcttcatacccaactgcaagtcctaggaatctctttataatcaggatagtattgtctcagagccttttgacatgccagctctttcttgtccaaaacacattttcacattctgcccttggagaatctatcctagggctctgcaacgccagcgtgccactcacgtaagtcatggtggtcaggtagatgcacagtttatagagggcttttacaagttgtatctcagtttgatcctcactgtgccatgtggaggaggcagggagctattatttctccacttcagaggtgctgagatggaggtgttttaactcttatcaacctttcaggtgtacgctgaactctctgtagattacatgttgatggggtccacaatgcacatctcaagtcctgtaacctgattgaattatggttagctccttactattaaaggggtttaggtgtggtttattattgttttcagaagctcaaggggaaatccttaatttgagcaaaatttatttcagaatatccattcattgtgggttaggaacctcatcccttacaattttccagcccccattttcgtcttctgtagtgcatcctcatcttttggtcagtttgatccttgaggcctctgtgaaatagaaaggagggggaggggggcgcagaatttccatatgattggttttagatgttgatttcggaggcctgtactgtgagtcactgaaattattggattgagtctygaagatccaaacacagagtgttgggactgtgtggttgggcttaatcctagtacaaaaaccagttcctttcagtgaagaagataaaggagaggaatccaggttcctcaatgaagcatccatacatagaagctcctgtgtcaggctgtggtgtttcccacttcctgccttcagtctagcagggttccttgcatttcttggtctaaaagtaaggcttatgggctctttctggaaagatcttacaccttttaaattttaacatgggaagaaattataaacaacaaatgacagtgtttgaattctctcacttttgagcaaagtcaagcagcttaagtatgwgagaataaagatattcccttctgttgcccagaaggagaaaaagatcattttatttaaaatctagctattgagatgcatgttccttgtgtctaatcaagttctgaatttgaactcaattagagctttgataaaaggaaggggaaaggaaacttgaaagaatgctgttccattcatgaagggactgtgtgtttttagtttccaagtaaatggcataatgggaccatgcattttccatccaagcattttccatcctgagaataattcccttcctggcttctcaatgaataatgcattatttctgaaacccaagaggcattcctttgattttcctttatgtttagctttctgagtgattttcaagcaaggaaattcaaggacttggaatgaatgctttattaacatttttattgaagttcaaattgctccttggctattatctcctgatatttgaaatatttttttctctccaaggaaagtctaaggtgttgtatttattagaaaatgaagtaccttggccaatcttcaaagtgaacagcagtttaaaaccaatacacatttgtgttgtagaacaaagagctttatgggggtacttttctcctttattttcatttccctgctgaaaagtttcacaaaagaaagctcagattcaaaagtgggctgtttggagactaaatctcatttgtttacattttgtgaaactaattccttgaggctggaccaaatccatgaccccagtccaagcctgcatccaccaaagccagcgccatttaaatctgaagatgcaaatgcccttctgggrttgctcctacttccgctctgcctgattacacatatgtagcctgcctgattacacatatggggcccattaggtgaggtgtaatgggacacagtggtgcccaccgctgttggctcatgttctttcagtagaagatccccagcagagtctggagtaacacagtggtaggatttaatgctattttacaacctccattttcctgggatccaaatgatgagtgatttcagaaactaaatgaaatagaattaagcatctcatctatattttcattcctcttacagttatagtaaaattgtaatgattcagaataattgggggaagaaagagaacaaagttgatctaaattagtagaacatctgaaatagtaaatttggtttaaaatatttaatgttatcattttcaagayatagaaatgtaatattttctagagcttgaactctggaggcagcctctaagaacagaaactctgggatttttctgctttccagtactgtggccttgagccagttatataaactttctgggtctcagttccttcatctgtacaatggggatattagtttctatgtcatatggctactgtgaaaattcaataarttattactggtaaagcatataggacagcactatgtgggtagttgttgaataaaaataaaacatagatcttgtcattgaaaatcacaatttccaaacaggcccatgctactcagcaggtaataattattattgttattgtagatacagattgagtgattatttccttaacacttgtttaatccatacaacaaaccttatgaggtgtaaatataatcatctgcattttcagatgggaaaattaaggaaagaaagtagtttgcctaagttcacccagtttattacatgtcaaacaaagatttgggcccagacaacctgaatccagaaactatgccttaattaaacattaaaggacacttatcattcgtgcttatcttttgcctgaaaataacactgctattaaaaaccatgttgttatgtgaggtgaagtgtttcctgaatgcagtttttcatatctcaattgcttatcaaactctttgtgttttgctcaaaataataatcatcamtgtctcataattgcttgattttagtaacgtccaaaataaaattttaagttgactatcgttaaattttttctgattttctcaggaaatgagtatttcatttgcgacaatggtggcttccaacttcagtatttttatattgaactgaaatcatttcactttatggtcgcatgttttataatattttttcattctctttttaaaaatccttctgatccctatccttgtccttgtaggggcctttatcatctgctggactcctggattggttttgttacttctagacgtgtgctgtccacagtgcgacgtgctggcctatgagaaattcttccttctccttgctgaattcaactctgccatgaaccccatcatttactcctaccgygacaaagaaatgagygccacctttaggcagatcctctgctgccagcgcagtgagaaccccaccggccccacagaargctcagaccgctcggcttcctccctcaaccacaccatcttggctggagttcacagcaatgaccactctgtggtttagaacggaaactgagatgaggaaccagccgtcctctcttgkaggataaacagcctccccctacccaattgccagggcaaggtggggtgtgagagaggagaaaagtcaactcatgtacttaaacactaaccaatgacagtatttgttcctggaccccacaagacttgatatatattgaaaattagcttatgtgacaaccctcatcttgatccccatcccttctgaaagtaggaagttgsagctcttgcaatggaattcaagaacagactctggagtgtccatttagactacactaactagacttttaaaagattttgtgtggtttggtgcaagtcagaataaattctggctagttgaatccacaacttcatttatatacaggcttcccttttttatttttaaaggatacgtttcacttaataaacacgtttatgcctatcagcatgtttgtgatggatgagactatggactgcttttaaactaccataattccattttttcccttacataggaaaactgtaagttggaattatcttttgtttagaaagcatgcatgtaatgtatgtatgcagtatgccttacttaaaaagattaaaaggatactaatgttaaatcttctaggaaatagaacctagacttcaaagccagtatttgtttaggtcatgaagcaaacaatgctctaatcacaatattaactgtttaattaaaatgttgtaacaagtataaaacagggaatgtaagtttattaccaaagtgatatgtattccaaaaaagtcatagaagatgaagcactataatattgttcccatatatttaaaatacccaagtacattctaattaccagtatatcagaggaaaattttcgtagtctttgtaaaataatatactcatcatagaaaacttgaaaaatrcagaaatgtataaaaaagcaaaaatgattactgataatatcacaacccagaagtaaccacctttaaaaagcaacccccatgtatgcctatatgtgtattgtatactttttttacataattggagtcatactgtaaacagttttataagtagatctttttcattgcaaaattgccacattttcttatggcattaaaaattttacaaaaacataattttaatggctatattatattccatttaatggatgcaactcagtttatttaaccattcccatgttgttaactatttaggttgtttctaattttcattattataaagttgcagaaatttggtgtacataaaactgtctccatataattgattattaggatatattcccatgaaggattctttttttaaaaaaatgtgaaatrtcatcttgtacttacacctttcatgmaaagggatttcctgcttttgtactgcatgggtggcagttgtgaggaaaagccagtcaaatgacctttttacaaaagaaatgcagtggtcacttcagttgagagtgactttttaatacaacaagatcaactagaagaattcaactgtctcaagaatcaaggtaccccaatatatctcgcaattccaaactttgtttgagggactcgttatccagctcttggtagccacacctgcaatgtaaaatggaagaaaatgcaaagaaaccaaatgtgccgagtgaataaaggattgtcatatcaattagtgtgggtccatctgtagcaaatgggttgagtgtgtcagtatgtggttggttactgtgtattcgccaggaatcaccccgataggctgccaccctattaggtgatacctgtttaatatgttgyccaggtagactagtagttgcatcagtttgctgtaacaagtaaccagtgaggtaacacagtggtgaagcaggtcaggggaggtcaggaggatgtctgagagaaagaagtccgggagatgaatggctgtctaggaaggaggatgtcagtgcacggttagtgtttgagcagagggcagacttgtaaagtacctgtagtgaaaagaatgtggggacccgattagcagaaaggtgtttgcacrtactttatacaaaatacagaatactttatattggaagtgaaagaaatgaacgtggacttttacacatgtgcatatttttctggaggctatatggattatttgaaatgaaaagcatactaattggactttaataaatcattttcaatcagcgtttggtaatgtgtggttctggtcagtgctatttctcttgttcgagagtcttccagcttgcattgcgtgggtgtttttcccactatgacctcctttatttctctgtaacaagggctgcttaaccctgaggcggagcaaccgtgtgctcccccagcccacgactgcttttttttcaatctgagtaataaatcttgccaatgtctgggaggtggtagtttatgttccttgagaggagacaatttattaagatggtactttacctcaacaggataaccgttagagtgggtttctttttgaaagactgattttacaaaaaattttgacaactttatgaaacactctcactagtttataaagtcacagtggtatttctacttataggtttaataaccaacaagataaaagttatatatatatcttccaatgatataaccattataacattttcagtatatcactaaggtgttggaaaaagataaaatatttattcaagtgaatgtctcaatgaggatttggaagagaattctgaacctttaattttaggtggatataagattgttagaaatcaaatatctttgaactggtctttacaaattagccacccctcacatatattcctctttttaaattagtgaaaccataattttcaagacctaaaaccgcaactaacgtataattaatgaatcttatcagccttccttttctccttcccagttagctattgttttaggttccactgttcatcttccagtttattccagaattctctcagcttctgaaatattatatactgcttctagctccttcccttaaaacccagagtgtgcactcatgctaggtaaaaactgtagaaacacctcttttatcacatcccttcactataacaaagtaaacagaacattttaatgaaaagagcttttgaaacaaagtgctaattgtttcatatcaactgagcttcacctgattccaaaccccataagaattagggattatttgtgggtttagaatggtggtttgtgaatgaggttggacactgcatgatagaagagatgtacgtaactaggagccaggatgtattgttaatcttcctaagcaagggctgttcatgttctagcattcacctgcatcttgtgtagtctacacagcaaattctctaattcttcccttaatgttataaagctcatattcatagactattaacaaaatattaaattataaacttaaatcataaattattagcaaatagtctatgaatatgagctttataactctgaatatgaactttaatgatgtgacatgtaatgaccatttgaaaatatgctgaatttgcaaactaaggcacatcagtcgaatccacttatttttgtatgacctatgagctgagaacaggttttacatttttaaatggttgggaaaatattttgtgacacatgaaaattataagaaatgcaaatgtcaatgtccataaataaagttttattggaatacagccatccttattagtttattaattccctatgactgcttttgtatcattaaatactagcgcagagtggagtagttgcaacagagtctataatggccctcagagtctaagatattcactctctggccctttattgaaaaagttttccaatccttgatttagaagattccattttcaaaaaaaaaaaaaaaagtttccattttcaatcatgctatcctcatttgattatggatgttcattagaagaggaagaaggagaaattgggcacaagattccttaatctagctctagcctgcagagagaattctcaacccaattttttatgttaaagataacttgcattttggaacttatggaaaagctaaccaaatttacagattttgtgaataaattgccaacatgatgccccatcagccctgaatacttttttatgtaattccacagataaggacattctctttcataacctcaatgcaattattaaagtcaaattaacattgatgcaggaactatcatttaattcacagatcccattcaaccttcatcaatttgtccaataaagtccattatagcaaaataacctaatccaggctggctggctgtattatctctctttgagtcttcttaaatcttcaacagtctcttagttttttcttgaccttcatgactttgtcacttaaagatcacaggtcattttttagaatgtctctcaacttggcttgtctgacattttcaatggtatatatatcatttatctttgacaaaacaagagagaaattctgctgtgtttcttccgactacatcccatcaagcagtacatcatgttgatttgtcctattatgtactttgattatgtagttaaggtgatgtctactaggtttgccactatgaagaaaacagatacctgttgcacacataccctcaatcatttttttatcctttgtaataagcaccctgtagagaggtaattgggactatgtgagtatcctgttccacatcaaattttaatgtctagttttagcatccattgatatttcttgggtgaattaatcattattctgattgatagttgcctaatgatgaatttctaattctcttttcaaaatgtattagcaatcttctgtgagaaactttttctctcatttattcactcatttatacccctatgaactcatgggttcctgttttgtttaattacttatactgttagtgtcgctttccagttaaatcttttcttttgagataattgcagattcacatgcagttctaagaaataatatggactgattccgtatatcttttacctggtttctcccagtggccagtatctcacaaaaccatagcataacattacaaccaggaagttgacattgatataatcaaggcatagaacagttccatcaccacaaagattcctcatgttgcaatttatagcttcatccaactcccttacccccattctgactcctagcattcactaatctagtcctcatttcttcaattacatttgatacttttctcatgctaaaactcataagacttctctgtaacaatggatgtggtgctgatacttccctagagttaacagacaggaagagagagtctctatacacatgaactatagactgtatctagtccagagagaaaccacgcaaacaaatatttcaaggaacacagaaatgagtaaagtagaaagtggaagtctcccctacagtttggaagttagaccacagataatctgttgcacacaacctgataaacagacattcacaaagtgattttacttttttttttttttttgagatggagtcttgctctgttgcccagactggagtgcagcggcgcgatctccgctcactgcaagctccacctcccaggttcacaccattctcctgcctcagcttcctgagtagctgggactacaggcgcctgccaccacacctggctaatttttttgtatttttagtagagatggggtttcaccatttagccaggacggtctccatctcctgacctcgtgatccgcccgcgttggcctcccaaagtgctgagattacaggtgtgagccaccatgcccggctgygattttacatttctgtttgttttgtggaactctcaacgtctctttggcatcaggaaagccagacttcattttgtttcatgtgtgacattgtttataatttgcatcttttaactcggatctttcatgaaaggaatctttgtattttctattatgaagaacatatagtgctgagtagtacttaacacttgtttatgtaaatgaaatgcgtgaactacaagtaaaggcatgcttaatgaagaaatgctctttaattccacaatcctgataaagggtttccttcacatttaagaatattacagttaaaattaagtcagaataatgtaaaagaaaaaaaaaagcttaaatccttcgattatgtgttctaccaatgtgtctgtgttttctgagtagtcaacttattttgctatgctttaggaaaaattttaatagcactactgtgttgcgtgggtaatgggatttatagctcacataaaacattcatataatttgtattttgatctttgtggtaactcttacacatgaggaaacagtctcaaagaaaaaactgggggtctaatatttgttgtttatagcattatttgatggctaattacatattctttatattgcaattgataattccttatatatatttatctattttgtctccccaaacaaattatgagttccttgagaagaggtatgatgttttatatattttttaatccctcaaagaacttagcacagtaaaagtaagagaagaaaacatgatgtcattaacaggtgcatgaactgtgctgtgcggtgttcatattattgcaggcatgcctatattccaagctagaaaacaagttagtaatatttgagagtaagataatcttgtgctttccattacttttttattataccaatgactataacaaaactagaaatatggtgtcactcaacagttcttaagtgaaaattttatgaccataattagatgtgatagttgatgttatcgctatctaccactcattctttgacttattcatctacaaatattttttcagagtcttctgtgtatcaggctcttatgatgttgctgtgaatgtgataagcaagatctttaatagaacttagttgcagcgaaggagaagaaaataagttcaaaataaaagtacaaattgtattaagagttatgaaggaaacaatggcatgacatagaaattaaaggaaaataaaatggatggtggaagatagggagaggaactatctttgaaaggataatttagaatgctctgtcttagaatgagaactgtcctgtcaaagccactcaccttgagcctgagttgcacagaggtgtgcccctgtcaagctcttgaacttgcactcactctggtaatcagttcacgtcaaaacaacccattagaaaaattggcacgcatttagcatatgcagataggaatttcagacaagatgtgtaaatgcttagtgagagaaagcatgccatttgggaaagaagggcaggtatagactgtgaggatgaggcttgaaaggcaggctggcgtgatgacttgagtgattttggaagtgattttatccttgagaattgtgggaaataagctaaaggatttaagtttaaaaaaaaaccacacaatctggtttacacttcagaataaattggagaagaaagactgaaggcaaaagataggatcagaggccgtcacattaactgagacgaaagatgaaggtggcaatggaggtgcagagatgaatggattcaggggtgtttgggacacggtgattgtttggataaagatgttttcttaagttatgacctcgaatactggatggatggacatgtgatacgttgagataaggaacataagagcaattttacagagaaaagataatgagtagagccttcaaatgagaattttgtggtaggaaggtggctatgtgaaacttgaagctcaggatatatccctggactgaagacttagattttggagtctgatttttttctgctgccatcttgctatattcttccctaagatgagaagcacacagcctcgatctgcttgaataagaagaaggaaatgagctaaaacaaggagaaataaaaaaaagcagaacttaatatctgaatgtattatccagaaacatgtgaagctgtttcttttcaacaaaataaggttatgtaccatgtatttgatttttaacttgataatacattatagatatccatccaaggtttaagtatgtgtctgccttgctctgcagttgaagtagagattattacaggtcatcaatgttttgtttaccccttcttcctggactcttggaaagctacaactctgttagacaggtttgtgcaactagttatgtccagtgggctgtgagtggatgtgacatctgtcatttctagacttgatgaactaaaataccccatgctagttttcagatcttttttctctcc

SEQ ID NO: 17726 - DNA, 176386 bp, Homo sapiens
  misc_feature (1)...(176386): n = A,T,C or G, or insertion/deletion polymorphism (see Tables 1-2)
ggtggctgttgagcacttgaaatgtgccagtctaagctgagatgttttttaagtacgaaatacatattggatttcaaagacagtacccaaacaaagtaaaaatataaaaatactttaaaatatcaattgcattttgaaatgatagcattttagatcttctgggtagggcgatcagcttgttctggtttgtcagggactttactggttgcaacactgataggtctgcatcccaggagataccttagtcctgggcaaacctggtcatttggtcaccctactatcgggttaagtatataattgtcattaattttacctgtttctttttactttttttttctttttttgagatggagtcttgctctgccacccagggtgcgatggcgcagtctcggctcaccgcaaccacagcctcctgggttcaagtgattctcctgcctcagtctccggagtagctggggttacaggcatgcaccaccatgcccggctaatttttgtatttttagtagagatgggatttcaccatgtcggccaggctggtctcgaactcctgacctcaggtgatccacctgccttggcctcgcaaagtgctgggattacaggtgtgagccaccgtgcctggcacctttttactttttgaatgacacttagaggggagccttagcacattagtggctgttgggcggagttgatcacatttgctcatttcacctagcagggaggagggccctgggagtcacactggctgataagttttgatggatgagtgcgaatggaggaaagtatgaggaactgagggccttggtcgtgggggaggaagaggttaccaactctgcctggagtgaatctgctgctcaggggcccacggaatggacaaaaccatgtcccaggcttggggagaccacggggacccttgggcaaaatacagcctttggagttagacccaggttcaagtccagctttgtccagtcattaccagctgaccaatagcaaatcttatcacttaatcactaatgaggggaacaagcattcaaatatagtcatgtgtacataatgacatttctgtcaacaacagacagcacaacacattactgttgtgtttgtggtgatgctggtgtaatcataaccttctgtgctgcagtccagtaaaaatatagcacaggccgggggcggtggctcacacttgtggagggccacctccacaagttgcagtgagctgagatcgcaccactgcactccagcctgggcaacaagagtgaaactccatctcaaaaaaataaaaaaacaaacaaacaaacaaacaaacaaacactttttattgcctgggtgtggtggctcacgcctgtaatcccagcactttgggaggctgaggcaggaggattgcttgagcccaggaattttagaccagcctgggcaacatggcgaaaccctgtctctacaaaaaatacaaaaattagctgggcatggtggtgcgcccctatagtcccagctactcaggaggctgaagtgggaagataacctgagcccagggaggtcgataataaaattttaaaaatttttagtagagatgggatttcaccgtgttggaccaggctgatctcgaactcctggcctcaggtgatctgtgcacctcgacctcccaaagtgctgggattacaagcgtgagccactgtgcccagccaacatacttgtttattatcaaatattatatactgtacataattgtatgttttatatatgtatgtatgtgtgtgtgtgtgtatatatatatatatatatatatttttttttttttttttagacagagtcttgctctgtcacccaggctggagtgcaacggcaccatcttagctcactgcaacctctgcctcctgggttcaaaccattctcccgcctcagcctcccaagtagctgagattacaggcactcgccatcatgccccactaattttttttgtatttttgtagagatggggttccaccgtgttggccaggctggtctcgaactcctgacctcaggtgatccgcctacctcagcctcccaaagtgctgggattasaggcgtaacccaccgtgcctggccaataaaaagttttaaatacagaaaaaagcttacagaataaggatttaaagaaagaaagaatttttgtacagcttataatgtgtttgtgttttaagctgttattacaaaagccaaaaagtcaaagaattaaaaaatatataaaattaaaaaattacagtaagctaaggttaatttcttttttatttttcttttttcttttttttttttttttgagacggagtctcactctattggcaggttggagtgcagtggcgcgatctcggctcactgtaacctccacctcccggattcaagcaactctcctgcctcagccttccgagtagctgggactacaggtgcgtgccaccgcacccagctagtttttgtattttcagtagagacagggtttcaccacgttggccaggatggtcttgatctcttgacctcgtgatccacccgcctcagcctcctaaagtgctgggattacaggggtgagccaccgtgcccggcctctaaggttaatttcttattgcagaagaaaaagattaaaaaaataaacttagtatagcctcagtgtacagtgtttataaagtctacagtagtgcacagtaatgtcctaggccttcacagtcacgtaccactcactcactgactcacccagagcaaattccagtgctgcaagctccattcatggcaagtgcccatacaggtagactatttttatctttttatttatttatttatttagttaatttttgagatggagtctctctctgtcttccaggctggagcgcagtggtgcgatcttggctcactgtaacctctgcctcctgggttcaagcaattctcctacccaagcctcccgagtagctgggattacaggcgcctgccaccatgcctggctaatttttgtatttttagtagagaccgagttttgccatgttggtcaggctggtctcgaactcctgatctcaagtgatccacccgccttggcctcccaaagagctgggattacaggtgtgagccaccacgccccgcccaattttatcttttatatcgtatttttattatacccttttaatgtttagattcacaaatacttattgtaacaattgcctacagtatcaatatagtaacttgctgtacaggtttgtagcccaggggcaacaggtgatcccctctaacctggatgtgtggtcgcctgtaccatctaggtctgtgtgaacacactctctggtgttcctatcatgacaaaatcctctagcattcctgttgttaagcaacacatgagtgtagttactgagtccctattgtgagccagggccgggtaatatattctctcccccaggctgttgtgaccatttccagtgagtcagttcatctgtctgaacaaagcactctggcattgattgtatgcaaataacctgttacagaatggttctacccataaactggctggcctcttttgagcaaccctcaaagttgcaagcccttgccctctgtcctggtcaacctctcttcctcagaagcttgcctgctctgaactcctctcccaaaccgggttaggagccccttctctggtatcagggcaccctgtgcctctcttacagacttgcattatggttctaactgtgctgtgtggcctgggcaagccgctcaaccactcggttatttcttctttttttttttttttgagacagagtttcactgttattgcccaggctggagtgcaatggcgcgatcttggctcaccacaacctctccctcctgggttcaagcgattctcctgcctcagcctcccaagtagctgggattacaggcatgcgccaccacgcccagctaattttttgtatttttagtagagctagggttttttcatgttggtcaggctggtctcgaactcctgacctcaggtgatctgcccaccttggcctcccaaggtgctgggattacaggtgtgagccactgcacccgacttgaaagaaattgctttgcactgtgcttggcacagaggaacagcaggtgttcattcaatgcttgctgttgtaattattcaggcttttatcaacagagggctggcctgagactctgccatatctcagaacctagcacagaacctggatgagtacagagtaagtgctcaatgtatgctgtggtaggcagagtaatagcccccaaagacgttcacatcctaactctcaggacctgtgaacattcccttaaatggcaaaggggaattaaggttgcaaacaggattagggttcttaatcagctgattttaaaatagggagatcatgttggactaaccagctggcccaatgtcatcttaagagtccttaaaagggccaggtgtggggaggttgaagctgcagggagccgagattgagtcatagcactccagtttgggagacggagtgagacaaaaaaaaggctgggcaaggtggctcatgcctgtaatcccatcactttgggaggcagaggctggtggatcgcttgaggtcaggagttcaagaccagcctggccaacatggtgaaagcccgtctctattaaaaatacaaaaattagcggagcgtggtggtgggtgcctgtaatcccagccactcaggaggttgaggcaagagaattgcttgaacccaggaggaggaggttgcagtgagccgagattgcaccactggactctagcctgggcaacggagtaagactccatcgcaagaaaaaaaaaaaaaaggaagatgtgcctatggagagaggannnnnnnnnnnnnnnnnnnnggaacatgtgcctatggagagattttctgtctgagagcactccacctgacattgcaggcttgcttttctgttctttttttttttttttttttgagacggagttttgctctgtcgcccaggctggagtgcaatggcaccatctcagctcactgtaacctctgcctcccaggttcaagcgattctcctatctcagccttcccagtagctgggattacaggtacgcgccaccacacctggctaatttttgtattttaagtagagatggggtttcaccatgttggccaggctggtctcgaactcctgacctcaggtgatccacccaccttggcctcccaaagtgctgggattacaggtgtgagccattgtgcccagcccattgcaggctttcacagagaaaaggggcaggagtcaggcgcgcaggcagcttctggaagttagaaaacacaaggaaacagattcttccctacagcctccagaagggaatgcatcctgccaacactttgtttttagctcagcaagacctgtgtgggccatcgaacctacagaactgaaggataatacatttgtgggtgtgtgttttcaaagacactaagttttggtaacttgttacagcagtaactggaaactaagacatgcaacaagccttattgttcatttttaccaccactactgggctgttggttatggtggaattacacttttctcttccattaggctgtgtgaactccttgaggttgtgcaatacgtttgtctgatttactactggttagcaggctctgagaagaatggctggtacacaggcggagctcaataaaagcccttactgaattttattcaatctatatgtggatgaagacctccgccccgcgcgcccctcccgcaagtcccactgaggcccgacccattctgtccggctcccagcccccgcgggtccccccaccccggggctgaccgggtgattcaggcagccctacatcctgctggggtggtgggcttcgagcgcgggtcccaggacgcagtggggcgcagtgcctgcggcaggcggcaggaggcgagcgtggcccaggaactcccgcgggagggtcgggacggggcggggcttgggggcggggcggctcagcgcgcaggcgcggggccaggcgcctcgcgcggccaggggcgggcggccgcagagcagcaccggccgtggctccggtagcagcaagttcgaaccccgctcccgctccgcttcggttctcgctccttcggcccttgggcctccaaacaccagtccccggcagctygttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcrctcgagttcctggaccgtgagagcrtcaagctcgtgtccatcggtgagttmtctggccgggcccaggcgcccactgtggtgccgacccgcccccgcgcgtgcacccctgcggagggcgaggatttcccgcagcgcgyccccacctcggagataagggggagtcgtccccaggggtgggwtatagggggcctagaccccctccccggtgtcttcccctgggatgggacctgttgtgatcgctccccgccatccgccccagcagtgcacctttggctggctaagggttgagggtttgggctggggtcacaggaggagaggtggagttgttgcatttctctacacctggggcgcccctatgggagctaggggactagaaaccctcgttcgctgtccccgggggcgggccctagggtcagatgctccgcggagtgctctccctgctgcgcccaggttggtgctctcagaggcagctgaatgggcgttggctcggaggccgggccgtgagacctgaggaggaaccgttctctgcgcctggggcctccctgcccaggtggagacagagacctggtaccttcccctgccgtcgctggaatgggtgtgggccccgaggttgcaagggtaggcgcgggtgtgtgtcctcgctctctctgctcccagctcagctctggccgcgcgccgcaggttgaacccactccttgctgccgaagttataatttagagatggtggtggtaacagtaattgctgtcttgtagggagcccaactagcgtccactgtgtaccgtcagccttctaagttatctccgtccctacgcatcctgccatctggggtgaggctagacccattttacagataagggggtccggagggttaattgacctgtccaaggtcagcaagtagggcccagctgagaactgaaggaagtgggcaacagttagaaggaggctttgttttcctctcctctcccaaacctacaccagggtcttcctgaaaggagggagggaattggtgtctcttgctggactgggccttctggtctggggaggaagaataaggatgaagtctcccttgtggtctgagatagttggaggcttcccagagggccacaaggctactgatagtgtgggctgtgatggtaggggctgtgatgtgtgtgtgcatgtgggcgtttgtgcagagaacgtgtgtacacacatagcatgtgtgtatagcatgtgcatatgcaaagagtttgcatgtacacggaatgtatgcagagaatgtgtatccacctacacgtgtgtatgggtgtgtgtatgtgtgtgtgtgtatgtgggtgggtgggtgtgggttggggcagaggagggttctgggtctggatctcttcctaaggagaaccagggactggccctggcctgtgatttgggtctcttcctgaggaaaccaggtcactatagtgaccctagtgacaggaagaaagggagatgggtgtggctgccaggactttctccagtggaaaagggattccctctaggctgagcctcccctgggccttagggcctcacccttcccttcccccacacctstcctggcaggtaaggctgcttcctgcttcctgggcccagatggcagccgcaccacccagctgatctccagcagccctccccctccccaagggtggcttccctgcagaagaatctgcatggcacgctgttgtcttctttctggggtccatctcctgtactggggagggagaacctcagaatctcctggaattctttaccattcagaaaccagcctcccctctgaagaatcccaaggcccagctgggctcaatttggatctgttctttgttttaaaaatgtgtatttatttaattaactgaataaagaaacttaaagtaaaccagaagtatccaaatacgacatgaaatctctaaaacaacaacaaaaccaaaccaaaccgcagcactagcaaatcacagactgcctgatctacccactgtttacagaggcagcagctacttccagcactgtctctcatcagtgcccggggctgtgggtctcattctagattttgtctacatttttttacatggttctcctgattccctgctccccctccccaccaccgccccgcctggagatggagccttgctctgtctccaggctggagtacaatggtgccatctctgctcactgcaacctccacctcccgggttcaagcgattcttctgcctcagcctcctgagtagctagaattacaggcacatgccaccacgcccggctaatttttgtattcttagtagagatggggtttcaccatgttggccaggctggtctcgaactcttgacctcatgatatgcccgcctcggcctcccaagtgcgggggttacagccctgagccaccrcgcccagcccggtcctccttttattttcgaatccactcaggccctagctactcccattgtcccgacgttccagggttagttagcttcccttcctctgtgctgggcctgtgggctgttggcagcttcttcctgttcctaccacaacttgcattctatttttttcctttttaatgatttcttggatcatattccccagagtgacattcctgggttaaagggtgtgaccacatttatgacttgtatcattggctgcctaattgctctcccgagagatcttgcaacaaacaggttttccagcctctggagaccacagagagccctggcaagtgccaggactgctgtggggataaagcaggaggcttcttccctaagctcttgaggctgttgtgggtaatggtccttcatccttcaaggcaaagttacctccagcttggactaaggttcatatattcactgcttaggttgtgttacattgtgctgacaatgacactagcttcaatttgggggcacctactgggtgttaagtgtgttctgttgatcaccccattgaattttcatgctaatcattgattgacagcaactactgccctatctctaatgatctgcttctgcaagtcacttagagagttcagggcttaacactgtcctgggcatgtgttgcttagaaaatggygcctgttaattaaataaggtgctgtctaataattatctcaaaagtaatgccagggctggatgccgtggctcacgcctgtaatcccagcactttaggaggccaaggtgggtggatcacctgaggtcaggagttcgagaccagcctggacaacatggtgaaaccctagctctactaaaaatacaaaaattagctgggcatggtggtgcacacctgtagtcccagctactcgggaggctgaggcaggagaattgcttgaacccgggaggtggaggttgcagtgagccgaggtctttgtgtaactgcactccagcctgggagagcgagactctgactcaaaaaaaaaaaaaaaaaaagtcatgcccgaatggtttgcacaccgaagggacgttcaaaattaggggagaacagcctggttgtttgtttctgtttggttgatcatactcttgccatggttagtattattatctttatttaaagatgggaaacaggagtgaagccacttgtggaggtgacccagctagctagtaaatggtgtctgaaacccaggtctgcccagctgttgaattggagccttaactgacttgccttccagtttcagagatgagtaaaatacagcttttctctccacatcagagggtccctgcaacactaggtttgcaagtcttaggtgttagggtggtggctggatacccacactctgaacctctgaccttggacaaaatagggatgtcagggccttccatgattggcaggatgaatcctctgggctgtgatgaaggtctcacaagttgagagtcagccgggaattaagtgggatcagtttgcctcttgtgttttcctcattgtgttttggttggttggttgagatttcctactacccaatggatgatgttttattccatcgtcagggaaggtatcattgaatgaatacagggttttgtatgctttggataagaccagacagttgtggagtcattagaattgtgtacatgcctccagctctgagataggtggtgtttcaacagctgccagaggactctggcttttctgcctagaattcactgaaagacaaccctggctattgattcacatttgtggttcattgtaaggtaggcccctaggcgccatccaaaagttgaaaatttccttacgtttcttgttatgtgatgggcagttcatagtgaggactcagtgtctttaattccagctgtttgccaggagttggcagttttatttacttgtttttccaaaaacctttctgacatggggcagtccagccagctgggaggaaaaggggtctctcagcccaagaatgatgatcaaggcctagaagtttgggtggtgtgttttgttttgggcctttagagaaaggaattgtttccttttcagaggatgtggtctaaccctaaagtttacttgactgacttaaaccaggccagcgccagagcaggcagggtgcgtgttcccaagacttcgggtcactaggcagcttccagggtggygggtcactggtccagtcagctccttttccttcctctcccttttgtgctactactaccaaaataatttccaaataaccttaagttctgctctttcttgcatgtctagcagatgccagcatgtcttttgggtagtacagagagtgcttaaaaagtagcaaagttggccggacgtggtggctcatgcctgtaatcccagcaccctgggaggccaaggtgggtggatcacctgaggtctggagtttgagaccagcctgaccaacatggagaaaccccatctctactaaaaatacaaaattagatggccgtggtggtgcatgcctgtaatcccagctacgtgggaggctgaggcaggacaatagcttgaatccaagggcagaggctgtgttgagctgagatcatgccattgcactccagcttgggcaacaggagcaaaactccatctcaaaaaaaagtagcaaagtagcatgctttgtcagaattattaataacaagttgtgggccatgtacaaggtggcacattagcattcaatgtcacttgtgtagtagttaagagcaaggattcttggttcaaatcccacttgccactaagtagctattagaaacttctgtgccttggtttccttatcactaaaatggggataataactaccttcttaaaaggctgttataaagattaaacaagttaataatttttaaagtgcttggcacagtttatggtacatagtaagtgctctgtgaatgcctgttaattaaataaggcactgtttaataatctcaaaagtcatgccggaaaggtttgcacactgaaagggcatttgaaatcagcgcgctctggggagaacagcttggttggctaaggttgatcctacttgctaaaatacggctatggactgcctagagggtgtcacctccttgaaaggggctgccccytgctatgttatggctgcctccagggcccattcacaccagctttgtttccaagctggacagggagctccaggcgtctggtcattccagcctcccacccctttcaggaatctctgggccaaatcacttccagatggtggttgggcctctgtggagttctcccagcaacggcggagccagcatgccagtcggcagccgccttcgttcttggagagtctgagctaaaggagggctttgatttggagccaaattgtgtctcttgggtcctggttttgtgctgtgaggcaggtaccatggagtgggctgctggcttagttgaggatggctgccctgctccttaggggagcagatacccagggcctggagcctttaggccctgcctccagtagctccatggtcagggtgccagtcaccttgcgttttctttttctttttttttgagatggagtcttgctctgtcgcccaggttggagtgcagtggcgtgatctcggctcactgcaacctctgtctcccggggtcaagcaattctcctgcctcagcctcctgagtagctgggattacaggcgtgcgccactatgtctggctaatttttgtatttttagtagagatggggtttcaccttgttggtcaggctggtctcgaactcccaacctcgtgatccacctgcctcggcctcccaaagtgctgggattacaggcgtgagccaccggacccagccaactttgctacatcagtttccaggtagcatatcctaggcaaaactggatgtagcctagtgattcagggcctcggtctgaagctagactgtctggattctaatccgcactctgcctgataccagctgtgcaactctagtccactgctttaacctttctgtgcctgcttccctgtctataaaatgcaagagcaaaatagttgctatcttagagttgctgggagcattatatttgatgaggttaagttatagcacagtgttgtcattatcactatgaatattgtgcttttggacccaagtccaggactttgtcttgtcttctgtctattctctggccagtccagatatttttggaatcctattgctgtcatctggtgtgttagctgttccctttctccaagttcagaacgtctgatgaagatgtctcccaagatcctttcttcctttcctcattcaacaaatatatgaaagcccatctctgaaccaggccctgtgctgggtgctaggacaacaggaatgagaggatcatgtcctttgcttgcctcagatactgctcagaggagaagagacaagcaagcagggagagccatgcagaggagagctgctcaaaccttcaggcccatgctcatcacctggggactttgttaaaaatgcaggtctgattgagtaggtgctggggtgtaggctgggattctgcgtttccagtcagcttcagatcctgctgtctgtgcaccgtgctgtaagtagcaaggatctaggtgccaagccctctgaaaaggaggagcacctgcccctaggctgggtatgggtaatctagaaggttccctggaggaagggacctttcagctaagacctaaagcgtgactagaattaggcaggcaaacagacatttacacaggagcagacgagtgtgtcagtttagaggtcttgatgctcaggtcagaggggcagtggaggggtgggcagggctggtttaccaagggctttctgaaactggaggctgcctatggggtatgctccttgagtttgtttgtttgtttttttttttgagttggagtttcaatcttgtttcctaggctggagtgcagtacagtggcatgatctcggctcactgcagcctccatctcccgggttcaagagattctcctgcctgagcctcccaagtagctggaattataggcatgtgcacacctggctaattttgtatttttagtagatatggtgtttcaccatgttggtcaggctggcctcgaactcctgacctcaggtgatccacccacctagcctcccaaagtgctgggattacaggcgtgagccacggcatccagccccttgtttagtgtagggtagtaaacccagccaaaaggggtcgtttatctcaggggtctcacctgttgctccagtcattcctattagcagaaagttttgtatgtgccccttcctcatatatatatatatttatatatgtatttatatatatttataagttataaacatactctactgtcaatttgtatattaaatattagtaaatcttagtttctttttagatgacaaatccaaatataaaatctgtttttttcctggctctaacggattatcttatgtccccttggggtggacatacctcttttggaggctcccgtgaaggtttgtgtttctacatttagtttttttcttttttccatattcttgttattctgcttttaattttcatctttgagtattctaaattaaggagctggatctgtaattgtaacaccttcccccaacaataagtttaactaatgaaaatattcaatggaatgagccattttaatctaaatggggctatttcctgcttttataatgattacagttgcttttcatgacattctactagaagccatcttacattactgttgtaaatctagttattcattaaacgggcacagtaatccctaaattggctcaggttattgtataataaacaacaatactttcttcttcaggagcttgagaagtgatcttgtatttttaaggtgcctaactaacttttcatgggaaactgagtccatgtactgggaagaaagctttttggggaaaatgattagaaaaccaaatgggtctctttatgactgaagtgatgaaccagyaggtgagagtaggtatagatggtacagaggacggaattactgggtattttaatcaggcccacttagtatcacaatttattattctattctatttttattattattttttgagatggagtttcgctcttgtcatccaggctggagtgcagtggcgctatctcagctcactgcaacctccgcctcccgggttcaagagattctcctgcctcagcctcccaagtagctgggattacaggcatgcgccatcacacctggataatttttttgcatttttagtagagatgaggtttctccatgttggtcaggctggtctcgaactcccgatctcaggtgatccgcccgctttggcctctcaaagtgctgggattgcaggtgtgagccatcgcgcctggccagtgtcaggatttattctgtgggaggggaggaggacaaagaaaaatactgagctatgtttgaagctcctgccctctaagagccttagagcagctgacttaaatgtgttcctttgataaactgtagatggttgttgtaactcttctgcaaactgtttatttttaaaaacaatttgatgagattttacttatgcccattgtttgagtacagcatttaccaaagaacaattttggccagatcccatgcagtagaatgcccttggccaaaattttcttgtactataagcaaagaagcagtttggtttttcacttaggcaagactgcctatcagactgagttattgtgacagagccgctgactctctccctttccccattatcaaaatctggcttttctaagcagcgcatgtaaaaagcttggcaaggaggacccttgtcctcctacatattattctttggctcttcttggtaccaagaatacatacaaataatgctggctgtgtactgaatgttgaggtgtgcactgttgaggatattcatcctctaatataacatctagtatttctcacaccttccgtctgctgagcattggtctatcttacttatactacttctaatcctcgtgaactctgcaaaactagtggctttacatctatgagaaaagaaaagaacttttatcggaagaaggtgagtccttttaaagtatcaggcctggaaagacattaaatgagacagcgaacacatcctgctaccctctttgagctatgtattcattgactttttttttttttttttttttttttgaggcagagttttgctttgtcaccaggctggagtgtagtggtgcaatcttggctcactgcaacctctgcctccggggttcaagtgattctcatgccacagcctcctgagtagctgggattacaggcgcctgccaccttgcctggctagttttggtatttttatttttatttatttattttaagacagggtctcactctgtcacccaggctggagtacagtggcgcgatcttggctcactgcaacctctgcctcccgggttccagcgattctcctgcctcaacctctccagtagctgggattacaggcgccttggcaccacagccagttaattttttgtatttttagtagaaacggggtttcagcatgttggccaggctggtctcgaactcccaacctcaggtaatccgcctgctttggcctcccaaagtgctgggattacgagtgtgagccattgtgccccgcctatgtattcatttcttaaaattggttgctggctaggtgtggtggtacatgcctgtcctataatcacagcactttggaaggccggtgctggaggatctattgaggccaggagtttaagaccagcctgggtgagatcacatctctacaaaaaaaaaaaaaaaaaaaaaaattatctggatgcagtggcacaagcctacatagttgtagctgcttgggaggctgagttgggaggatagcttgagcccaggagtttgagtctgcagtgagctatgattgcgtcactgcactctagcctgggcgacagagtgagacccgtttctaaaacaaagaaattgctattgtcacaattagttataaattaatctaataatgctgcacgcagtaccataatccacaccctatagcttaacgatggatggccaaccactaatcaatgctatttctgtacgccaatgagaattcctgacaaaaaactttgtatcagccccactccctgtctgtcccctcttttgcttttaaaaacctgcttgtaacaaaggccaaacagagctcatatccaaggttacttgggcctgagtctttcaggcagctgtcttcactttggctcaagtaaactctttaatagtttaaattttaagcctctgcctctttcttttaggttgacatctgtttccattttacagatgagaaaactgaggctcagctctgcctcactttacaggtcaggcttaatccctaatccctgcctgcatcatgctgtaaaggacttttgtgtcaaaactgagtttcacactctgtaaagtaaaatagatatattgtagtgagagggtgtagaagagactgttttctgcttctgtggattttttttcttcctgttttgctttgctccaaactttactcatttgcgcttgattcatgtgaaactgaaatttccttctacagaacaaaactttttgggggctacttaccatatcttttcccacaccgtggagctctgactgggaccttttccagtttttggagacattgctccagttctttccctgcctttggtttccagggggcagtaatgtcaccgcaggtgtggacagtagggaccagctaaaggttgctttggaggaggtgggcagggcttttgtttgtgaggtctagaaaccagaggtgaggaaggaggtgtccctggaactccccctggctgcagggctcacagcacacaccatgacaccrcaggggtktgtgtgtgtgtgtgtgtgtgtgtgtgtgtgtgtgtgtgtgtgttgaggggagtgttgttgagagccaactatgccaggagatccttggtgacagcggacataggcacagctatgctctgtcaggaatgagttcacccacacccttttcttctgctaccttgtttaactggtgggagggtgtgctgggttgtgtttgctggtgagcccagcaactgcacccttctttccaggcctagcacccagcctttatcagtctcatggccctggcacaagtgggcagcctgcttccaatccaagcaggcagctttccgctcatctgcaggtagcctcgtgctgtggcagcacaaagttgtgtgagccagagctgaacttgtgatccccacgggcatctcctgaggcgcacctctcctgagagagaaagctggtccgtccagcccattcagggctcagcctccccagccgtcgcagggctggcttgctgaaaggtctgggtgttaacacagcactcctgttctctctctctgaaggccctttatgctggcatgaattccttttctcatagagatctgaaagctcttttgactaaatgggtcacctttctgagtattttcataaggctgtcagcctttaccrtgccagacaagttttctggaatttcctttccagaaaaaaaaaaaaaaaggctactaaagaggttggagttatttggaacacagggtggaattctggcattcgaactatagggaaacgggtggggatttgtggcaggcactatgtaaatttgccgcaagcccataaattcagactttaagatgaaaratggcaagcagcagtcagctttccttcaacaggcaggaacggtgctaccttccgcctgtgctgagtgtgactgagggagaggcaggcctcctagggaggccggggcaggaaaggtttcttggtggctaaaataggatttctcagtttccccygtgtcccaagaaaataagttcttatcatgcttgtaccacacttcttgtgcgtatcaccctggtttccctgcacctccttgaagtggtttatcagattccagggacacaagaatggtttggcatctacagcctattgtgggagcaggggcccggcctggtgcttcttgcccaggaacaaactgattgttcccttggtgtggggtaaagcaggccagagtatgggaccaggccctgcctcccaggggacctgaggtgcaaggtctttgagctgagaccctaaaaggcctttgtgagtctgtagtgctatcagttgagcagagttcagggttctgtttacaagattccctctcagcagaggcagggaggggtacctgctggaagaccaggaatgtgctgctgctgggatgggggccctcggtggagcttctagccatctggaggcagaacccagaatgtgttctgagtgaggcgccttggcagagttggcttgaaagcacctaggcagtggcttgtcacattccttatctccaccaaaggaggcaagctagcacctgggggatggctctcccatcagggagtcctttacaggatgtgatccaggtgtcacattacacttcctgcaggtgtgcacctcttacctaattgtctctcctatccctttttctcagcactattgtctgacatccatggggagtcacacccaaagttgggcatgaggtcctctcctgggcacccaacaccttgtttttttgtttttgttttttttggagatagagtcttgctctgtcacccaggctagagtgcagtggtgccatcacagctcgctgcagcctcgacctccttggctcaagcgatcctcccacctcagcctcccacgtagtcagaattacaggcacacacaccaacactgctggctaattttgtattttttgtagattcggtttgctatgttgcccaggctggtcttgaactcctgggctcaagcgatctgcctgcctcagcctcccaaagtgtggggattacaggcatgagccacctcacttggccacactgccctcttactgagccgtattggtgttctaaatggccttcttactctcccacgggtcatcagtgctccaggggcaggcgctgtgtctcttgtttacctctgtggctctgaccttggcacttaataggaatttaataaataacttgttaaataaacagtctctagtataatagcttgagtattaagactggtacattgacttatttgcaattcagaaaatgcaaaacagtggttctttgctgcctttagtgaagtgggaattatatgtagtagacaactgggtctggggccccagtggaacacttcgtttttggactgtgatgctgaacttaaagaactcagcagttcatgttcattctctggacatctgtgatttgcttcaacaactgttagagaacaaggccttttccaggtgaagctcagaaaatgaatttaataggaaattactgaaagtcacaatcatagtaacagtttcattagttacagtgaatatagagagagcccatacaaagtaccaggcattgtgataaacgcttcttactaatagctatacaaaacatcattgcaattctgagaagtagttattgttgtaattcccgttatgcagatgagaaaactgaggcacacccagattggccagtgagtgtgtggttattactcagattcttgtctgagattttaatcttcatattttactgctttcccaaggaaagccatcagctcagcaagtctttgaaatttgcttctttttttttttttgagacagagtcttgctgtgtctcccaggctggagtacagtggcgcaatcttggctcactgcaacctccgcctcctgggttcaagcgattctcttgcctcagcctcccgagtagctgggaatatagttgcatgccaccacacctggctattttgtatttttagtagagacggggtttcaccatgttggccagcctggtcctgaactcctgatctcgagatccacctgcctcggcctcctaaagtgctgggatcaggcttgagccaccgaactcggcctttttttttttttttttgaaatgatgtctccttttgttgcccaaactgcartcttggctcactgcaacttctgcctcctgggttcaagtgattctcctgcctcarcctcccgagtagctgggactacaggcacgtgccaccatgcccagctaatttttgtatttttatagagacaggcyaagcttgtcttgaactcctgacctcaagtgatccacctacctggccctcccaaagtgctgggattacaggagtgagcccctgtgcccagcctgaaattcaattctaataaatttttattggagcattaaaaagttacatctgtagttgttactctttgcaaaaaattgcaagaacacagaaaaatataaagaaaaaaatcacctgtgaagaattttaatgaatctttttctacttttaggsgattttgcttacagctgccttttaatcagaatagggaagaaagagattcctttctcaggaaaaaagtgactgtggactggaaatgctttgtgaaataattttggtcatactgatggttataacaagattcgtcttcaattgagttattgctgagctttgtccaacattaaaatgaaaggtctcatttgagtctcattgtggtttgcaagtctcccttggtctagaaatatgtttggtcaaccacggcatggaggtgttccagccactttctgtctcttaaaagtttttaggacctacttttattgggactgccagggtctcttaataatagttattatacttggtaactattgtgaccttgtctcataggcagcccagcatagaaactcatttagcttttagttgctcagctccattagctgtttaaacatgtttcagatgtgagcctgacaatgtacttgggcagcttggttcacccttgactgcctgggaactttgagaagtctgaaaattatatgtagccctaaggtcttcatggtattgtttttttggaggcaccatttcccaatagccctgaggacaccaggcccatgaagccatcctgtctcagccaggaggcagaggagatggaatggaaaccacttctggatacagatccagccacttccggagtgcttcagagcatgggtcagatagaccttgctgctttctagctggcagacttggggaaggttgtttgacctctctgagtttgtgtcccagactatagcagtacccccttactggcgttatcgaagataaaatgatataatcctgataaatcacttgacccagtccttggaggtggtggtgggggctggggtaagtgccccatgaatggtggtcatcatgctccccaccaacctcctttctctcttctcctttcccgtctttcacacccctaattcctggacctgggggtggtctctccagactagatgaagaagcaatctaattatctaggaaggtgaaaggtggttgggaatactcccagaaataggycaaagataccgcctcctacctaacagactctttttagaagaagaggcaacctgggtttttggataactgttgagtaggaaccatcatgagtggcatttctgcatttctggtcttctggccaagcctcctttttttttttttttttttttttttttaccttgagacagtcttgctttgttgccaggctggattgcaatggtgcagtcttggctcactgcaacctccatctcccaggttcaagcgattctcctgcctcagcctcctgagtagctggtactacaggtgccgccactatgcccagctaatttttgtatttttagtagggacggggtttcatcatattggccaggatggtctcaatctcttgacctcatactctgcccgcctcggcctcccaaagtgccagaattacaagcgtgagccactgagcccagccttccttttttttttttttttaagtagctccattgccctccctcaccctttcttttgtctcctgtaatgtccttcccttccatttcttttttttcttttttcttttcttctttctttctttctttttttttttttttttgagataggatctcattctgtggcaaaggctggagtgtagtggcacattcacggctcattgcagcctcgacctccaggactcaggtgatcctcacatctcaccctcccgagtagctgggaccacggcacacaccaccacccccggctaatttttgcattttttgttttgtagtgttttgccatgtttcccaggctggtcttgagctcctgggctcaagtgatactccctcctcagcctcccaaattgctgagattacaggcataagcctctgcacctggccttccctctcatttttttttctttcctggttttgcctgtcccagaccaccctcttggaaagatgctctcccagcagcggcagtaaggtcctggtcttgtgtttgctcctgggcctgagtcttggctttgctgctttgtagctagctggctgacaccagggagctgcttccctccaggagcctgtcgtccatatgctgaatgtgatccttaaatgctctgtcttacaggggccagacattgtggctcatgcacttcagggggctgaggygtgcagatcacttgaggccaggagtttgagaccagcctggccaacatggcgaaaccctgtctctactaaaaatacaaaaattagccggaggtggtagtgtgtgcctttaattccagctacttggaaggctgaggcaggaaaatcgctagaacctgggaggcggaggttgcagtgagccragatcatgccactgcactccagcctgatcaacagagcgagattgtctcaaacaaacaaacaaaaaatgttctgccttacagagttcttaggtataaaagagaaggtgcctctaaagctcttggcaccgtgcctggcttatagtaagtgcttggtaaacgtcagctgctgctgttgtggtgttagtatcagcattgttgctgtgagaccctgcacttcccacttagccttggaaaaataagtcttcacgttaatgccatgggctaccgcttctcttttcagggcttcttggaggagggtggagatggagagacaggtgggggactgccagggttacatcctccatgaggctgaggctgtgctgactgccttgtgtgctttcaacctggagtaaagggtggctgtgccagctgctcccatcccccaggagtctgactcgtccctgccttggccctgggcagcactttccctcctagctctttggcatctggggtcatggtggggccgcctgccatctgtcaaaatttttgctgccctgggtgtggtggtaaacccccgcactatccaacttggtgtcatggagctggcgacaatatttttacagtggttagtgcttggaaactggacttctgggttatgccctgtacaaacagcatcaaagtcgctgggctagggtgacagaggaggctgccaacagggaattctgtggctcctgggacaggaatggatatgggaggttgggggccartattttcggttctcttgaggagttggcgagtattagtctttgccctgatggatagaaggaatctgtctgtgtcttgcatgaaccgtgtacttcccccagttactccttggacaccagctgcctgctgttcataattgggccagatttctaatactgcagcgctaccaaatgtcagttttaggccatctctggtgtagccagggaacgcccaacacctttcccaaaggtagaatttgtgtgggttttacttcactgagtgactaatgcagatctttatgttttaatgatgggaagaaattcgtcagcctgggtactttttccatgtgatggggcaaaaatttaaaacacttgcacaacggcttttgtttctccagctactaaaggtgactgtcatttaggcattatcagtatgatcagctgatgttaacccactccccttctggagacccgtttctgtttctgggaaaggtgtaggacatgctggatttggcaagattgcaggtcccaggcagatgtccggacttagactctggctcttttttttttttccagacagggtctccctctgtcacccagkctggagtgcagtggcgcgatctcggctcaccacaacctccgcctcccaggttcaagggattctcctgcctcagccccctgagtagctgggattacaggcgtgcaccactatgcccagctaattcttttttttttttgagatagaggctcactgtcacccaggttggagtgcggtggcccggtccgcctgcctcagcctcccaaagtgttaggattacaggtgtgagccaccgtgcctggcctcagctaacttttgtatttttagtatcaacgaggtttcaccatgttggccaggctggctttgaattcctggcctcaattgatctgcccacctcggcctcccaaagtgctgggattacaggcatgagccaccgcgcctggcccagaccctggctcttactcctaggtctacctctaccatcactggggccctcgcctgaaccttttgccccatctataaaatgggagaactagactaggtctgtgtcccccaagcttcaatcatttgtaaaggaaccacctttactattttgccatatcccacggctgtctctatttcatttttcacttaatattattttcccctgcagttgactcacttgtaaaacaaatgtatttgaaaaggagactttgtgtcactataataayggaaaaacagcgtcactaggtaaatggaaggtaaccataaataaaccccaaacagttattaaattccagccagcactgttgcctgttcacaacatgaggcatactctcttttggttaaaaagggaaattagcaagagatggagaggtgttgaaggtaacctagcactacattgagccttttccttgacctgctcaggaggattgagaaagaactaggagaactgggaagagaataacgtctttttgtgatgcaaagtgcctgagtgtgaccaagagctcagagtagtaatgtatagatgctttgtttggatacttatgcagccattaccatgtgccaggggtgtagaggggctaggagtatagaggggattgggacttgttcactgacttctggttgcttgtggtctagtagtggggaggtggtcatagaatattgaatacaaacgaagatcgaacaggctgcaggggtttaataggaaaatcacaggactaaattctgtcatgtgtacatggggtctacaaataagagttgtttagaattttttttaatttaaatttcccatgaaatataaatctatttcattccagaatgattctagagaagctctaaatacattaaagttgtgttggctgggtgcagtggctcatgcctgtaatcccagcactttgggaggctgaggctggaggatcacttgtggccaggagtttgagaccagcctgggcaacatgggagaccttatctctaccaaaaaaaatttttttttattttcttttttttttttttgagacaaagtttcgctcttgttgcccaggctagagtgcaatggcatgatctcagctcactgcaacctccgcctccctggttcaagcaattctcctgcctcagcctcccaagtagctgggattacaggcatgtaccaccacacccagctaattttgtattttttttagtggaggtgggatttcaccatgtcgatcaggctggtcttgaactcctgacctcaggtgatccacccatctcagtctcacaaagtgttgggattacaggcgatagccactgcacctggccaaaaacattttaataaattagctgggtatggtggtatgtgcctgtaatcctagctacttgggaggctggggcaggaggatcccttgagcccaggaattccaagctgcagtgaactataatcaggtcactgcactgaagccggagtgacagagtgagaccttgtctcttaaaataaatttgtgtcattgtttgttgtttttatggtgttatgacartgatccatcttaaccctttatgtagtggtaactaactttctcttttcctaaaagctgatttgagttttaggttctcttggagtctgtgacaattgtaaatagataagatataacaaaatggcctgaaatactcttgcaacactcatatttcccccctcagattagcatgttctatactctctgcaaagcaagatatacaccagaattaggcctctaaaaagcctcatactgctaatctctgggaatgaatggtgttctttgggataatgggatatgaagctcagtctgatttttctgttctgctggtagcttagggccccctttcttctgttgggttttttgggagaagggaagttgtgattaagaatgagaattctttttttttttttttgtctcaagagtcttgctctgtcgcccaggctggagtgcaatggctcgatcttggctcactgcagtcttcacctcctggtgtcaagcgattctcctgccttagcctccaagtagctgggaatacaggcacctgccaccatgcctggctaattttttgtatttttagtaaagatggggtttcaccatgttggccaggctggtctcgaactactgaccccatgatcccaaccccccccacctccccggcctcccaaagtgctgggattataggggggagccactgcatccagccaagaatgagaatttgggagtcaggcacctctgggattgaatctggaattgactgagtgacatgctttctctgaggcctccgtcctcactgctctcatctataaactgggaataatcatagtttctatctgaaacagtgggtgtgaagatttaacgagctaaattgtaaagtgcctgagacatgggaagaagtcaggatgtgctaatgggtaatcttacacttccccaatggaaagggccaggtttatattactctaggctggtagtaagcgaggcaaaggagatatcaggtttcagctttgttagaacatgctaatggcaccaggacactcagaagagatacagagtttgagacaaatggcaccatgagccctgagacattgtgtatggggtgaatcggatagcaagaatagacttcaaggagggaagtagggcagttagaatcctttcagctgcaaggaactgaaaactggctcacatagaaggaaaatgattggctcatgtcagcaagcctagatgcagagcaagttatgggtttcagggatccagcatctaaatgatgtcatcaagaacccaagttttttgggtctctgctctgttggtttctttcatcctaaagctggttctcctgtggtttaccatagtagagttcctgtgagaactccactctgaccaatcaggccttcccagagccagggatggatggagtcgcttcttttgaggcccatgggtcctatctggaggggatggatccagactcctatcaggaatctaagaggggccgggcacggtggctcatgcctgtaatcccagcacttcataatgccaaggtggacagatcacttgaggccaggagttccagatcagcctggccagtatggtgaaaccccatctctactaaaaatacaaaaattagctaggcgtggtagcaggcgcctgttgtcccagctactcgggtggctgaggtgggaggatcacttgagcctgggcacagaggttgcggtgaggttgtggtgagctgtggttgcgctgctgccctccagcctgggcaacagagtgagaccctgtctcaaaaacaacaacaacaaaatcttatgtaccccataaatatatacacctactgtgtatccacaaaagttaaaaattagaaaaggcaaattgcagagatttccatatgctatgataccgtttatatgaagttttacatatgtcataaaaatacagataacctttaggggaatgatcattaccaaacttttggataacggtttctggggatgggcagagagggctatacagtcatgaagaggtgtataggggctttcaactctttgtagtgttttatttcttcagtcccatggtggttatatgattcttcactcccctttttttgtgtggaatatttttcttataaaaagtgtgtcttttatttatttatttatctttttcacatggagtctcactctgtcgcccaggctggagtgcagtgttgcgatctcggctcactgcaagctccgcctcccgggttcgcgccattctcctgcctcagcctcccgagtagctgggactacrggygcccgccaccacgcctggctaattttttgtatttttagyagagacggggtttcactgtgttagccrggatggtctcaatctgctgaccttgtgatctgcctgcctcggcctcccaaagtgctaggggattacagacgtgagccaccgcgccctgccttttttttttttttttttttttttttaaaggcagagtcttgccctgttggccaggctgcagtgcagtggcctgataatggctcactgcagcttccacctcccaggctcaagcaatcctcccacctcagcctcctgagtagctgggactacaggtatgtgccaccaagcctggctaatttttccatttttaaaggttttgccatgttgcccaggctggtctcgaacccctgggttcaagccatcctcccaccttggcctcccaaattgctgggactatagacgtgaaccactgcacccccatccaaaagtgtcattttaatgctgacatactgcattactaagcttgaccaggggaagagaaaaaaaaataccttgtgtttattattttgtttgtttgtttgtttgagacagggtcttgctctttctcccaggctagagtgcagtggcatgaacatggctcactgcagcctccacttcccagggtcaagccatcctcccacttcagcctcccaagtagctgggattacaggtgtgtgccaccacacctgactaatttttctttttttctttttttgtatttttggtagagacagggttgcccaggctggtcttgaactcctgagctcaagcaatcctctcttcagcctcccaaagtgctgggattacaagtatgagccactgtgcccggcctgtttgtttgttttaaagacaagtttgggcccagtttataagaaaagaaaacagaccatccttagggtgtcaggatgatattttgacaaaggcattcatgcttagcaggatttctctccccctacccccaccccaagtgttgaaacgsctgagctaattaccttagaatgtaaggcttcctctgttgcttgtgaacgtggcagacttgggattctcagagacagagggcttcagaagcttgcctctgggagcgtccagtcaatagctttttgtctgagcagaaggagatattgctcaaggtaccatctcaagggactgctgaatcagttgcattgtctctaaaagtaggtaaaagtctagagtagggctggttcaacagtggaatgagtgttaagagagagttgcattctaagaacacctttacactgtggccaaattcaagcaggtccattttgtggtttggtggtccccatctagtgggatgtggtctggtatcccaggcacctgcatatatgagctcagatgggtttaatttttgaaaaactgctttattggctgggtgtggtagctcatgcctgtaatcccaacattttgggaggccaaggcaggaggatctcttgagcctgggaattcaggaccagcctgggcaacattgagagatccccatctctacccccttccccgccaaaaaaaagctaggtgtagtgacatgcacctgtggtcccagctactcaggaggctgaggtgggaggattgcttgagcccgggaagtcaagactgcagtgagctgmgattgcatgactgcactccagcctgggcaaaagagtgagacattgtctcaatctccccacccctgccaagaaaacccaaaaaatattgaggtataattgttatacaatgaagaacacattttgattagyttatacacacactcctgtgtacacatgtacactcacacatcaggaaaccatcaccataatcaagacagcgaacctcyctatccagccccagaagtttccttgtgcctctttgtaattcttgccttttatctctccatgtcttccacacccatgctcaagcattcactgatctgctttctgtcattatcastcagttttcatcttttagccttttatataaatggaatcatatagtatgctgtttttttttttttgagacaagagtctcactctgttacccaggctggagtgcagtggtgcgacctcggctcactacaacctccatctccccagatttaagtgattctcctgccctagcttcccgagtagcagggattacaggcacatgctatcatgcctagctaatttttgtatttttagtaaagatggggattcaccatgttggccaggctggtcccgaactcctgacctcaggtgatcacccgccttggcctcccaaagtgctaggatcacaggcatgagccactacgccctgccagtatgtactctttttgtctggcttcttcyagcatagttattctgaaattcatccttgttgcatgtgtcaatagtcctattcctttttattgctgagtagtagtccattgtatggatatactacattttgtttatacatccttctgttgataacatttgggtggtttcttatttatttatttatttttgagacggagtctcactctgttgaacagsctgragtgcagtggtgtgatcttggctcactgcaacctccacctcccgggttcaagcaattctcctgcctcagccttctgagtagctgggattacaggcatttgccaccacacctggctaatttttgtatttttagtagagacggggtttcaccatgttggtcatgctggtctcgaactcctgaccttaggcgatccgctcacctctgcctcccaaagtgcagggattataggtgtgagccaccacgcctggcygggtggtttctaaataaagctatcatgaacatcttttactactctttgtatggatgtatatttctatttttctgagtggaatgttaggatcatacatcataggtgtaygtttaactgttcaagaaactgccaaactgtttcccaaagtggttgtattgttttacatttccacgagcagtgtttgagagctccagttcttgcacatcctagccacaaaaaggttctgttttttaaagacaatttttttttttttttgagagtttcgccctagtcgcccaggctggagtgcagtggtaagcgaatccctgctacaggccagagactgttctcagttggtttttacaccaagtatcgcacttcattctaacactccaccattttacaaatgaggaaaccgaggcactgagaggtttagtaacttgtggcacagccaggaagcagtagagaaagactttgaatataaatgtatccattaggatgtatatggttccaagtcatgggaaacctacctaatcctggtttatccaaaaagggagctcattggctctcgtaactgaaaagtcaaggggtaggcaggcagttggacctggaagtctccagggcatcagagagccttggctctgcttctctgattctgttgtctctccacagacgggtgggtgtagcagtcccaggcccgcagccacaccccacacctcccagaggaagaaggygggccctgatcccagcagtcccaggaaagccctgaggttcactgtgattggaccagcctatgtcacctgctcacatctcagcccaccactggcaagggtgtttgactcttgggaatgactcttgggactggcttgtcctagatcacatgttctacctgaaattggggacattgcagaggattggtggagtggacctcaaggaggtgtttcacgtggcttcctgtgwcactaggttgccatttattctttagaaagcccctttgtttgatgaaaccctggtgtcacaggctgtgtgacttagggtaatccccttgtccacatctgtgaagtgagattacctcttcacctcacaggcagatcaaacaggaaaacaaaaacaaaaccaaacccaaaatacacgtaaattgcagagtgcttgaggtttcttttaagctgtctatgtaattaaaagctgttacttagacttggatatgaaataaaatctgacttcaaatttaagtggtgtaatttccatgcctcttaaaatatcaggtaacttcatttgtgagcctcagtctgtagacttgagggatttccatctgaagagggggcagaatggtggtttagggaacgcaacatgtaccccacccccaacttttttaagaggaagagttgaaagaaataatgaatgtgtgagaaataaggggtttgattgccttccagggtccatgttgaaggagaggaaaatgtagctcaaccacagtgactctccccaattaaaaactaaaaaaagatccgtggttatagggcttggacttcggacaagccagcagcctcagtcattgtgagtgtgattccagattggaaggttctgctaggaggaaagtggaagttttgagaattcctagttggacagaatgcctcttgatcacggccttagctaaaggagaccactctttgctggatggatcagtcagctacgtgtgaagtttggctcagtacaacattctcggcctggggcggcagcatgggaaagatttttattggaattaactttctacagagatgtactttcaaatgagaccatccttctctcactggtgagctcacccgggctcttattccacaaagcttaattgttttggacccatacatttaaactccttaattaattgactcaagacttaggacagatttgcttttctttataatgactccatggctgtaaatgctgctgattcagatgaaagaggaccctagagcacagaatgagaaggacgtggactcaggatacctgtttctttattctgactgtgctcttcgtcagctctggggctttggaccccagttttgtaaccacctaacgagttcaccttgcctgctgcctagacggagctgatttatcaagacagaggaattgcaatggagaaagagtaagtcacccagagccagctgtgtgggaggctagaattttattgttactgaaatcagtctcccgagcatttgggatcagagtttttaaagataattcggcaggtaggggctcaggaagtggggagtgctgattggtcaagttggagatggagtcacagggggtcgaagtgacgttttcttgctgtcttctgttcctgggtgggatggcagaactggttgagccagattaccgctctgggaggtgtcagctgatccatggagtgcagggtctgcaaactatctcaagcactgatgttaagttttacagtagtgatgttatctccagaagcaatttgtggaggttcagactcttgcagtttctgacccctaaaccttaatttctaatcttgtagctaatttgttagtcctacaaaggcagactgctcccaaggcaagaagagggtctttttgggaaagggctattagcagttttttttcagagtgaaaccataaactaaattcattcccaaggttagtttggcctatgcccaggaatgaacaaggacagcctaaaggttagaagcaagatggagtcggttaggtctgacctctttcactgtctataatttttgcaaaggcagtttcagtttctcacctgtaaacgttgaagactgagccagaatcagggtcatcaaatagcaccccggctatactttcttctcttcatgacaaacattgctggtcagttgatatgatgttctttcccacygggcccagacttgacattagagtcttttttttttttttttttttttttttgagacagtctcgctctatcaccctggctggagtgcagtggcaccatctcagctcactgcaacctccgtctccagagttcaagcaattctcctgcctcagcctctcaggtagctgggattacaggagtgcaccaccacacccagcagatttttgtatttttagtagagacggggtttcgccatgttggccaggcttgtctggaactcctgacctcaggccatccgctcgctttggcctcccaaagtgctaggattataggcgtaagccaccacgcctggccgacatcagagtcattttagcctgcaatgcaagttgtcctcagtgggctgctagcattggcttcaaccttcatatcagccagctaaagccccttgtaatgaatggggaggttccttcacccttgcctcccgctgcctcctcttgaccactcattttttttcttgtagttcaggaaccaattcagatgatttccctcgtgaagtcctctcgaaagcccccaggtagaattattcattttttcccttgcattcccacagcactgtgcacacaaattagaatccttgtaaaatggccatgattctgtttatgaccctggccctccaccagaccagcctctctgccctctggcttttttagatcactggcatggtttctgcctactccaggtgccagtattattttgtgaatgttttttttcttcatatctactcatctttatactactttactcgtaaaaggaaactagagaacatgatcttaaatgaaaaccacgatcacttgccagaaagaacaggtaactaggctttgaaaaaataagttagaggagatagcataagaaaaaattaaaaaataaataaaatcaatgaaaacaacgtgttactaaattcttgaaaagttttttgaagactttgagcctgaggcctgttcttattgtttgtttgtttgtttgtttgtttgtttttatgacagagtttcgctcttgttgcccaggctagagtgcaatggcatgatctcggctcattgcagcatttgcctcctgtgttcaagcgattctcctgcctcagcctcccgagtagctgggattacaggtgcccgccaccatgcccagctaatttttgtattttagtagagatgggtttttgccatgttggccaggctggtctcgaactcctgacctcaggtgatccacctgccttggcctcccaaagtgtggggattacaggcgtgagccaccatgctcggcctgttcttattgttaaaaagagagatttgtgtgaaagctgctgacgtctttttggcaccaagtcaagactgagttagttcttgtcagaatctgattgtttgtgaattgatggcttttttttttttcctgagttgggggtctcgctctgttgcccaggctggagtacgaccactataacctcaaattgctgggctcaagcaatccttccgcctcagctgcccaagtagctgggactactaggcatgctccaccatgcccagttaattaatttttttttttttttgagagacagggtctcactatgttccccaggctggtctcaaattcctggcctcaagtgatctcctgcctcagcctcccaaagctctgggattacaggagcgagccactgtgcctggccggattttaaagttctgcccatgcacctccttagctctggcagttactacttgcaggcatctcctttgtctgccctgccccttgttaggaaaggctgtgctgactgtcagctggcacccagtgcatagaagagatagttctctgtagatgatgttgaacaatgtggtactataatcccaacctgttgtatctttgtttactctcaaaagcaacaattgggctgggcatggtggctcatgcctgtaatcgcagcactttgggaggctaaggtgggagggttgcttgaagttagttccttttttttttttttttaaaaaaaaagacaagatctcgctctgtcaccccggctggaatgcagtggcatgatcatagctcactgcagccttgaccacgtgggctcaaggaatgaaccattgtgccaggagttcaacaccagcctggataacatagcgagaccctgtctctacaggaaaaaaaaaaaaaaagaagaattgcataagtatcatcagaactgttgaatggaaaatcagactttgtgggtttggtttgttaattacttctcgttggattagaatttgataggtaaaaaaaaaaaaaaaggtgtagaaaagtgattccagtcttgagcaaatttttaatggaaaacggtgtcttggttctctgttcactacaacttgtatctaagggaaagcctagtgatgcagacatttcatttcgtgatgggaaaactgatgcccagaggttcacagctgaccaggggctagtctgactggggggatctaggtcaccaccccccttgccttgttttcccagctagtgcatttcctactagacttgactctactgtaattcaagttgctgagtagcaaacaagaactacaatgactagaaggaacagaactagcttttttgtgctctgaaagtggaaacttattgagggttcttttcctcccagagaatgcagaagtgccctgatttgcttttggaaggacaccattcactttattgcctcttttcattgttgcccagaatatcaccatgatttattcatgggtggtggggagggtagcactagtgtatgctcccagcaaagaggaacatctcacgttgtgaagagatgcgcaaaactaagccagggcagggygtggtggctcatgcctgtaatcccagcactttgggaagctgaggtgggcagatcacctgaggtcaagagttgaagaccaccctggccaacatggtgaaactctgtctgtactaaaaatacaaaaattagctgggtctgattgcaggtgcctctaattgcagctacttgggaggctgaggcaggagaatttcttgaacctgggaggcagaggttgcagtgagctgagactgtgccgttgtactctagcctgggcaacaagagccatctcaaaaaaagaagcaagccagatctttggggtgctgtgayggcaaatcccccagcgctggcctctcaggttctcttgcgggattagtgtttgttgaataataagcaatacaccctgacccagcgagccaaagcaaacaggacagtaactgaaactgcaggggagtgtgagtaaacagttaccttctaccctcatggagctggcctctggccagcaacatgatagctgtttgcatcttactcttatggagccattggccctctcattaaggtgggggcagcttctggtccatgcctgcaagtcctcatgggagtgggtacctgacagggtgtaaagggtaggtctgaggacatggtttcttttttttattgttgttgagatggaatcctgctcttgtcacacagtctggagtgcagtggcctgatctcggctcactgcaacctccgtctcactggttcaagcgattctcctgcctaagcctcctgagtagctgggactataggcgcatcctgccatgcctggctaagttttgtatttttagtagagacggggtttcaccacgttggccaggctggtctcgaactcctgacctcaggtgatccacccacctcagcctcccaaagtgctgggattacaggcgtgagccaccgtccccagccaacatggtttctttaaaatatactccccgctccatcccattcatgtgtgggagttgagctgcatctgggtttttcttttctctttttctgtaaatctttattgtattttttttggatcatagaatggatacatgtttcttaaagtttgatcattatagaaacttaattagactattatttgagtgctaaccatagtgagtgagtgcttactgtgtgctaggtggctttttatgcctcatgtcacttacatgaggtctgaggaacggtgttaatcccgttttgcagctgaggaaactgaggctacatttacggtcacctagctggcaagcaagtggctgagcctggagcagcagcagatctggggaactccacaaaccagatttctgtgtggtatccctgtggacacaaggatttaacttgattctttttgctttcagtatcactttatgatattacaatgagcttgcagtatttattttcagaagaaaagccagattattcccatttatgagagaagcagccaggtgggcagggatttccagcgctgaaccagccagtgtgtgcattgtctcttcccgctgagcggccctggtgtgctgggttagtctgtgagccacaggaaatgttgtcagggcctctgggcttttggatgtcagcaggccttcagtggtgaggrgrttgtggctggactcagaggactccttgcttttgctgaacgaccctccccaccaaccaccaccaccaccaccagtgggactagcccatgagctgtaagccaaccttttcmttcctaacttaattttccaaagaatagtaacttacccaccaccactgcagtcactgggccgggaagacaagcactcttgccttgaatccatgccttgagccagtagccttgacccagggtaaagcagttatgtgcttgggtcacctgggtcatgtttttgaaattgcctcaagcctaccttacaaatccttcctggaaccctgcttggcttttctttgtgggcttcccttaggagggaagcttcccgagcagcttgtcttgactgtagccagctgggtggtcccagccacagaatttaactgtcaaacagcaccagaagggttcctcatccagctgtcttgccccaagtgccctctttgctttctttttagagagttctgagactcattagagagtttagagattttagcattcttgaagttctttctgtggtcagtttggtgaaccacttcatttctaaagtttctcagttgaccccattcttccccagctttgcattctccatgaagccacctgtgtttggtgtgtatgggttttctgcaacctaggttgaacaagtcctctagaatcctgaacaattggtgattcatgctggcctggtttttctaattggcctggaaatgtggctgtagtggacacaagtggacttggcctcctctttgatgcgggtaaactttagatttgcattagctctgtttgattagaggatcttactggtttttgttgttatttatttaccttttaggagctttagtctctgtaggtttttttttttttttttttaaagtccgggtcttactctgtcacccaggctagggtgcagtggcatgatcacagctcactgcagcccccaccttcctgggctcaggtgatcctgccaccttagtttcctgagtagctgggactacaggcatgtgccaccatgcccagcaaatttatttctactttttgaaaacagggtctcactttgtcacccaggccagaatgcagtagcacgatcatggctcactgcagtctcaacctcccaggcttaagggattctcccacctcagcctcccaagtagctgggaggctacttggcatgcatcacaaggcccagctaatttgtgttttttcttgtagaggcggggttttgccatgttgcccaggctggtctcgaactcctggggtcaagttatactctctcctttgcctccagccatgagccgttcgttgcgcctgggctagtcattatagatttatcccttctttcatctcatgctacaaaagcagttcttgtatttttacccgacttgtgattttctactgggaatgtttgtttgtgatggttagcagggtgctgagagggaattaatcccaggaggcccaatattgggccatgtcgtgctgttgagcacagtcatttgacacctataacttctcatcaattcttctgatagactgaggaggaattgggaaatttcctagagttttgtctgcattattgggttgttttgagaacataaaccttaaactctagctatgtaaactggataagtcattttggtaatttggcattccytttgttttttttttttttttttgagacagagtttcactctgttgcccgggggaatgatctctgctcactgcaacctctgcctcccaggttcaagcaattcttctgcctcagcctcccaagtagttgggactacaggcacactccactgtgtccggctaatttttgtatttttaatagagacaggatttcatcatgttgaccaggctggtaatttggcattcttttgagtacaagtgagagaaactcacttgagctggcttaagtgaaaaaattctttgtcaggagagttttgtgaatttctgtttagtggcaagttgtaraaaccacttgaaactgcttaaaggcaaaagagggagccacttgtcccagtaactgagacatcccagagccgactgcccccaagcattacttggtcccaagtttcaaacgggtcttcagggtttgatctctctcctcatctccagtctgcttcattcattttggctctatgtggtggcagaagggcttctggcatctctggacctttatgcctcccaggtccaaacccagccagaaaggagagtgagagtgctgagtgcaaaactctcctatagctcctatacaagtccaggatttgctattagactccttgaattatgtgcccagctctgagccaatggctgtgcttaggaggctcctgtctcatgcacccaccccagtactgggcatcagaaacaaccagtgatccctataatgaaccacgggttcacagacttaagtgtaatcctgcagcagggcctcaggaagacttgaaacccaaaatcagaaagccatggtttcttgtcttcctggtgtctgttttgtcccttccctctgtagaggagtcctgctatcactgcaggcaacggggctgccctgcagctcctgctgtttacatttcactcggtgtagccataggcagagacctcagggagaacctgattcggcttggattgagtcaggttccaccccagtccagtcagttgtggactgagaggtgatgaggctgggccctttaagacaaatctgggtgggtggagtctgtgcttaatgaagttgtgatgttagctgatggcccagaagggactggtaggtgcctctcattgtctggttgggaagcattctcttaagtccaagatgatgataaatagtattaggccaggtgccgtgtcatgcctctatacccagcactttgagaggccaaggtgggaggatcgcttgagcccagaagttcaaagccagagtgggcaacataaagagaccctgtctctacaaaaaacaaacaaacaaacaaaccaaaaaaaccccacaacaattagccaggcatgatggcgcacaccagtagtcccagctactcaggaggctgaggtgggaggattgcttgagcctggcgggtcgaggttgcagcaagctgtgatcacacctctgcgctccagcctgggtgacagagtgagaccctgtctcaaaaagtaaaaaattcaaataaataaacaaataatatcaagggcctctctcccaagctaggaagatatcagctgaagctctagcccagctacgtggatggctgcttcctgcctggaagcgatgcccagatcagcaccttgggacccccctgaacttgcctctgctccagtgtgggcccttccttcctgcagaggagacagcactgtctgagaggcatgaatgagaatttcctccttctaggcccaagtcagcatgactcgaggatggctttgactggaaaaactgaatcaaagagtgtgctacagccaaggatttccccaaacactaatcagtgctgattacttccagggtattgcctttggctctgtggagttttgtccactgtggctgcaatgtctggcttctgctgcccagaagatgagaaatgagtttgtagggatgagcctgggtgaagggatgtgccccctcaccatcctgacctctattaggtgtaaaagaccctgattgccaaattcataggtcatgggttggctctgcctccagcattaacacttgggggtggagttggggaatcatagtattacttgcataaatggaatcctaaaagtttgttgggacagtttcataaaaatcctcaccatgatcagtttgaaaatgacgttcccttcacatgtttgtcttctgaactgagttgcaatgctgagtatgagtttgagagtcccaagaccatctaaagcaagcctgtccaacccacagactgcaggctgtaggcrgcccaggacagctctgaatgcgccccaacacaaattcgtaaactttcttaaaacattatgagatcctttcgcatttgttttttaaagctcatcagctatcattagtgttagtgtatcttatgtggccaagacaattcttcttcttccagtgtggcccagggaagccaagagattggacacccccgatttaaaggaagtaactcaattttgtgaacctgaaacttgatcttggatgaaccaaatgaaattttatgattctcttaagctcacgaaagttcaataactgtgctgtgtaaaatagaggtaaaagacttgagttggaccaggaatggttgctcatgcctgtaatcccagcactctgggaggctgaggcgggtgcatcacttgaagtcaggagttcaagaccagcccggccaacatggtgaaaccctgtttctactaaaaatataaaaattagccgggcgtggtagtgtacgcctgtagtcttagcttcttgggaggctgaggcaggataatcccttgaacccaggaggtggaggttgcagtgagcaagatcataccactgcactacagcctgggctacagagcgagactccgtctcccaaaaaaaaaaaaaaaaaaaaaaaagacttgagttggttctaatagaataccttggagaacctcaagatgccttctggtccagccaggtttacagattggaagatattctgttaatcagaatctcagagagggacaggccctgatcaaggtaacacagtgagttgtggtagctgggctgggctagaacctgggcctccttggttccaggtcacagggaccaagggatttggcttgtcttagtcctacttgtaactacaatactgccttctgctaggaagaataagagcttgcaggctagaggaatttataggaattttctttctttaaaaaaatccccccaaaaccagctttactgagatataactcacacaccataaaattcacccttttaaagtatgcaatttttagtatattcacagaattatgcaactatcatcactataattttagaattgtttttttttttttggagacggagtcttactcttgcccaggctggagtgcagtggtgcagtcttggctcactgcaacctccatctcccaggttcaagcgattctccttcctcagccttccgagtagctgggattataggtgcatgccaccacacccaactaatttttgtatttttagtagacatggggtttcaccattttggtcaggctggtctcaaactccgcctgccttggcctcccaaagtgttgggattacmggtgtgagccactgtgcctggccaattttagaatatttttattgcctcagaagaacccctgtatccattagcagtcactctccctttcccttccccaaccaggcccaataaaccactaatctactctgtctctatggatctgtccattcagaacatttcatatggtaaaatcatacacgtgttctggtgttactgacttctttcacttagcagaatgttttcaaggttcagccatgttatgtctgtactttattcttttttacggccaagtgttggaatgtgtaggatttgaattttcaaataaagctttaaagttttcagatttatttttactttgcctggtgtgttttttcctggaaagccaacttctacatttggagattaaaagacaaactttctcaaactccctgtacctaagtggttgctgcttttcttaaatgttttgacaccaaagagaaaaattggtttctggaagaaagtgtgttttcttttattgccaagaaaattagtgcatgttaattaatatagatgctcaggacccagagttgtaatgaacttttttcttatatttattttctagatgtttgacttattttaacagttttcattttagcaataatgtttccttcccactcccaaatttattggaaaccctcaatcaaccctatttatttatttattttagagatgggatctcactatgttgtccaggctggtctggaaaccctcactcttatagatagtatgaaagaagattatagccaactcttatataaccttccccagagcctccaattgttaatgttttgccatatttgcttgctctatcacttgctctaaagatgcatatcacacactttttttttttttaatttatttttgagacagagtctggctctgtcgcccaggctgtagtgcagtggcatgatcttggcttactgcatcctctgcctcctgggttcaagcgattctcctgccttagtctcctgagtagctgggattacaggcacgggccaccatgcccagctaatttttgtatttttagtagagatggggttggccaagctggtcgtgaactattgacctcaagtgatcctcctgcctcagcctcccaaagtgctaggattacaggagtgagccaccatgcctggccacatgcgtgttttttattgaatcatttgaaagtactcagctcgtatcatgacccttcacccccacatactccaacaagcatctctaagaaaaaggacattctcctaaccasagtgtctctgcattcccaggacattcttctaaccacagcgtcactgcatacccaagaggttagcaccgatacagtaataacatcttgtgtaaaacttcccaaaatgctcccaagtgtcctttatgacagtttwaaaaaaaatggcattttttgggatccaggaaccaattaacgattactcaattgaatttggtttcaaagtcacatacctcaacttttcctttaatcaagaacagcccccctgccttttacacatttttttgtctttcgtgaccktgtcatttttgaagaaatcaggcccgttgtcttgtagaactggtgtttctcaagtgtgcttgggagggtcttggtaaaatgcacattctgattctggagaacagggtggagcctgggaatctgcatttccagccagcatcccggtgatgccagtgcagctggtcttcggctgtagaatgttccacattctaggtctgtctgtttccttgtgattaaattcaagttgaatatttttggctagggcacttcctgaggtcataggtacttcccactgcctcacagcacaggctcacaatctcagtttgtcctgttacttcgtggtgctaagtgtggtcacctgcttcaagtggtgtccgcctgctctctgttgaaacaatacctttctcctagtataatgattaggtaacctgtgattgtaattggtaagtaatctttgagactacatgaatatcctgttccccagcagttttcactcattggtgaactgttttgggaaaaataatagcatcttacagttataataccctgctggtaacacatggctcttacataatcagcagttaattgtttgtatgtgtgttaatttttatttttaaaatgtaactagtgactggtaactctcatttgtattttaaacattggcttttacagcttctcagtacatttcactctgtgtatgtttttggtagagcatttgttgtcctgtataatggtttaggaaatcctataggccaaatgaagggctggagactcacctgtgttcccaccactgtgtttcactgtgtattgccagagaaaatacagttaaatttgaatttcagatagacaatgaataactttttagtataagtatgttccaagtgtggcagacagctctcacaagttacaagtcgttgcgtaggacatacctatgctaaacgatttgatgtttatctaaattaatatgtaactgatatcttgtatttttatttgtacgatcttccaagcccacgtcccaccgccttctcggggatggccaccatttgtgtttgctgcctggtggtgtttgcagctgcgagaagggccttggaggaggagcaaagtgtagtggtatctccgtgctgtggccttgggcactggggtgggggttagatgagtaattagctgaatatgacctcacccatgaagaatgtgcccttgctaggtattagcagaggtttaggctccagggagccattgtcagaagcttgtcagtgatgtcatcagctggaagggccagctttcaggcctcaggaaaaagcttgaaagtcagggctccagttttggtaataaatgggaatggagtttcacaggtagggtgtggaggaatttattgtgacaggaagcctgatggagcctcttgcctgtgtgcagcccccagccaggtttctgagttctgatgaactaccagaaacttccaccacggsctgtgattacactgttggcccaatgccctggaaaaattggcttgctctcggggaacactccaggagctgcaaagrgggtgtcaggactgttgtgcagctccccttaaattggggaggaggggtggctgatgtggaaactgttcattagactgctcagggtagtgtgagaaaacgtgtaatctgtgggcatctacccctagctgcccctctgatctcacccactactgtgggaggaccccgtggatgggggcagaggagggtcttctggatttagacactcacaaaacttccttttaccttgttcattggaagaaatagaaaatgcctttttttttttttttttctttttttttgagacagagtctcgctctgttgacaggctggagtgcagtggcatgatcttggctcaccgcaacctctgcctcccgggttctaacaattctcctgcctcagcctctggagtagctgggactacagccacgtgccaccacacccagctaatttttgtatttttagtacagacggggtttcaccatgttggccaggacggtcttgagctcttgacctcgttatccacccgcctcggcctcccaaagtgctgggattacaggcgtgagccaccatgcctggtctctttttcatttttaaagggtaatttgctgtgcaggagtgggctctcagaccagaagtggggacctgaatgaaatcaaggactgagtatggtaactacagccatttaattttatttgaagtctcccgtaaaatgttctggaaaaaacaggggttccagggctgggtgggcagtttcaatcatggactggattttgtggttcagatttctctgggcctgttggaggttccccttaagcaattacccaaggcagttctgcccagctgaagtactgattacctgcacactataccagtgaggactcatgggtgagcagatgggaggcactgagcttgattctgaaaccctggcctccatcccacctgacattcaatgtcagattagaatttggaagaccctaagtctccagattggtgcactgggtagctcctgaaatggggtggctgagacaggtcctctgtgcccccttccacagcttcctctggggcccttctgctcactggcatgtgcttctgggcaaataggcctctcccagcatttgttttggctctgtgaaatggggtaatatttgttcctattgcgggtgaagcgctgctgytgggatgctcaggtaactcactccgtgggtagctgatattgcctgggcaagtggcattttagaggaaatctgtgccatcaaaagagttggacctgatcacacttttgcttttgaatatgctttgtcccagcctggccattygtcacttgggaccccctgrgtctctctgaccccactgtaaaatggatatgccatggagttgtcccaggaatcaagggcaggtcctctccagtgagtgatgggcttgcctctcacttctctaacacccttctgcttccttgtgyaagatttcactattagtggctattctyttttacagaagaaaaagggagacgcatgcctcttccagttcactgttcaccattgcagcatatttattccaagggactggccgaatcatccctttctttgttagaatgtggttttgttgccttgagacaagtggcccgcatgtctgcactgaaggaggctttgcgcaatagccttgggcacctccggttctgcaagcatgtacagtacttgctctcctttccctttctttgtatactttttctggtctgctacgtgtccatctgcatgtggataaagggtcgtcgtcttgagtagtgattttgctgtgatgtgattcctgtgaggtctagttgcacacagtgattccgaaggtagacccagctggaaagcttttaaattgctgatactccagccccactccccaagagatgctgattttgttttgttttggggagggcagttttttgttttttttttttaagctttttgatgtgtagccagggttgagactgaagtgatttttgtgagtaacggagaagtgttaaggcttgagaagttggaagagccatgcttgagataggaccaaggtcatatccccggcattagcacagagcaaccctgacctgttggagagttgggctggatggatgcggtcaggggagagactcgctttattttatttatttagagatacagtttcactcttgtcacccaggctggagtgtaatggcacgatctcggctcactgcaacctctgcctcctgggttcaagtgattctcgtgcctcagcctcctgagtggctgggactccaggcacgcgccgccacaccctgctagtttttgtgtttttactagagacagggtttcaccattgttggccaggctggtcttgaactcctgacctcaggtgatccgcccacctcggcctaccaaagtgctgggattatgggtgtgagccactgtgcccagcctcgactcgctttattatatccacacttggaatacaattcggattgattgtagtggggcattttataattaggaaaaattaatcaggaaaaatcactccatgtagattagtaccaccatatgaggggacaagaatttcttcagattaggaacttcttccaacaggactgacagggtccaaaactactcttggatccagctttaagatggacccagcccactgttgagtcccctctgaggtcttctctctgtggatggatttgattgttaacaatggctgagtcatgtggcacccagcccggtgagtaagacagctgagtaagaggggaaacagggcctttggtcagaaaaaccagactgacttcagtcttatctgtttagagaagccccagaagctgcaaaaattgcagcttccagactttagtgtgccrtggtcatgacatcggtgtggatggcaggttgtcatctgagcagtcagggtggcagcacacagcttgcgggctggctgatggccgaggtgtgtgaactgacctgccccaagtgacttcagtgctgggcacagcataggagcagtactaatgatatggacagtatgctcagaggacgttagggagcacagctttgtgtaaagggmatgccctgccctgtccggatttaaagcagctatagcactgaaaccccatggtcaccctygcatttctacacttctgcctgtgccaagtctagtttgtgtgcctcctccattttgtgtgtacatgggggtatttttttctgctaggcaactgctatttatgcctctcagtactgtacttagtgtgtaccattcctgcaaggtatagacattgtcagcccattttacagatgaggaaaatggagtttttgagagggtgagatcattcagtggcagaatggaatgttaacccaggtagtctaacctctctgctgtagatctgatgtccatttgaactttagacttcccatctgtgtctacagtctagcccttaaaaaatgtgataaacaggtttttaggtaagtctgttaatttcagaaagacattattattattttttagaaagttagagcttatgttagggctcagtctatcctcctgcctcagctgcctgaatagctgggactgcaggcacatgccaccatgcctggttaatttctgtggtatacatcattgattactgagaagtcacagtccgttgttaaataactgagctattcatagccaaatcatttttaaaaacacaaatataagcaaaaacaaaacatttatttatttatttwttgagacggagtctcgctgtcacccgggctggagtgcagtggcgctatctcagctcactgcaacctctgcctccygggttcaagtgattcttctgcttcagcctccccagtagctgggactacagacacccactaccatgcccggctaattttttttttatttttagtagagacagggtttcactgtgttagtcaggatggtctttatctcctgaccttgtgatctgcccgcctcggcctcccaaagtgctgggattacagacgtgagccactgtacctggcccaaacatgtggtttttttaaatgaaagtgtgttcattttacaaacagtgcattcttactaattttacaggccctgtgctagggacatggcctcgtcttccgctatcttagagtgaagaagtaaagacagagaaagtgttcacaagttgctgcacaagtctcattgcagtgcctcccagaggcgcgaagagcaacacctttcacctgggctgtcctagaaggcccrtggcagggtggggttggtgaacactggggcttaagggggtgaattcagaagacaaaggaccttctgggcaaagaagggcccagtagtgggaagtgcaggagtgtgagagtgcctggaattgcccactcactggctctggagcttggtgctgagtgcttgggaagtgttgggaggatcagttatattgctggctgggttctaaagaacctccaaagtttacataaaagttacctttgatttgactgttctaccctccagtcacgtggctaaattaattaaatcaaatttaaaattaagctcagccataccaagtatatccagtgttcaataggtacatgtggcttgtggctgatgcactggacagtgtacatataaaacatttccatcgttgcagaaacttctattgaacagcagttgtattagtccgttctcaacactgctgtgaagaaatacctgagactgggtaatttataaaggaaagaggtttaattgattcccagttccacagggctggggaagtctcgggaaacttacaatcatggcagaaggggaagcaaacatgtccttcttcacatggaggccgcagcaaggagaagtgcagagagaagagggggaaaagccccttataaaaccatcagatcttgtgagaacagcagcatgggggtaaccattcccctgattcaattacctcccaccaggtccctccaatgacctgtggggattatgggaactacaatttaagatgagatttgggtggggacatagccaagccacatcagtgttgttacacaccacagtggtgctgtggtgtgtaggtgggaaaactatggcatgggggccatatctggtcctctgcctatttttataaagttttattggaacataggccacactcatttatttatgtactgtctatggatgctttcacactgcaacaatagatccaaatagttgcaaagagactgtgtggcccacaaaacctaaatatttactatccaggccaggcatggtggctcatgcctgtaattccagcactttgggaggttgaggtgggcagatcccttgaggtcaggagttcaagaccatcctagccaacatggtgaaatcctgtctctaccaaaaatacaaaaattagctaggcttggtggtgcttgcctgtaatcccagctacttgggtgtcgagacacgagaattgcttgaacccagaaggcagaggttgcagtgagctgggatcatgccactgtactccagcctgggtgacagagtgagattctgtctctcaaaaaaaaaaaacttactctttggccctttatggaaagtttgctgacctcttctgtagatggtagggtacggtagaaggtgttcaagccaggagtaacatgaatgattgtatttatggcctaagaggataactcgtggtggtgggcgggccatatttgtggagagacccattttcagtgacttccaagagtctgcgtgagagatgactgaggtcttgccctggcaggaatggttccattaatctgtgtctcatttgacaaatgaggaactacaaatgggaacagtttaagatgagatttgggtggggacacagccaaaccacatcagtggtgctaatagacagtggtgctgtggtgtgtagtagggaaaactatggcctgtgggccaaattttgaagtccttttactttttggttctaaaaattattaattgtagccagagttgttaacttaatatgtcttggaccccttgggctctctgaagactgtactctttctttccacttaataatatacatggaattgcaaaggaaaccaatgatattgaaatagatatcagaaataaaatttttagatatagcaataaatgcacatctgtattaaaatgtgtaataacaagatctaacagtgagtctaagaactactataattatcatgtagcaatggcataaaggatagtttgtgctatctaaaacagtcaatgacaggagaaaatctgatttctttggtgataaaacgacaggtgctgctaatacacctgtgttttatggtcttcgtttgtaatgaaaagaaatgccattaataaattttatttatttatttatttatttatttatttwtttwttttttttttgaggtggagtctcactctgtcgcccaggctgaagtgcagtggcatgatctcggytcactactacctcctcctcctgggttcaagggattcttctgcctcaggctcctgagtagctgggattacaggcgcccaccaccatgccaagctaatttttgtatttttaatagaggtgggggtttcaccatgttgaccaggctagtctcgaactcctgaccttgtgatctgcctacctcgggctcccaaagtcctgggattacaggtgtgagccaccgcacccggccagatgctgggatgttttttaagaccttagaccctaagcctatcatatcaaatacaatgaaacacacccacttttcacactttaaaaaaagtgtgttggtgtttattgctgtaaaatagtttgaaactttttaaaaaaagttttggtcttgctcatacttgtgttttaaaaaagtatttggctatgactaactcagttatgtatttatttatttatttttgagacggagtctcgctttgttgcccaggctggagtgcagtggcatgacctcggctcactgcagtcgccgcctcctgggttcaagcctcagcctctcgagtagctagaattacaggcgtgctccaccatacccagctaatttttgtatttttagtagagatggggttttaccatattggtcaggatagtcttgatctcctgacctcctgatctgcctgcctcggcctcccaaagtgctgggattacaggcgtgagccaccacgccctgtgactaactcagttatttaacaattgactgtaatttctcagcaatcagtgtatacttggaaattcttgggatgtgagaaaactaacctataactcattttcttttttctttgaggtgaggtctctctttgttacccaggctggcgtgcagtggcatgaacagggctcactgcagccttgacctcctgggctcaatcctcccacctcagtctcctgagtagctgggactactggcacgtgccaccatgcctggttaatttttgtattttctgtagaaatggggtctcactgtgttgcccaggctgatcctgaactcctgagctcaagcaatccacccactttggcctcccaacataccgggattacaggcatgaatgagccaccatgcctggcctgcaacttctataaatagcaaagttagtaattagtgaagatgatggtttgcaagcactgaattatacttctattaatttcatttcctttcaattttctaatgttttgtgcccaatctgtcctgtctgcctctacctagctttagaagtgttttgttggttcctgagatggagctgtgcctgaagggtatgaggttaccctctgggttcagcggggagatttgggaagagttttgatttgtaggccagtaaaggggcctgacattagatgatggctgctgggctagggaacaacttagaggcagctaacaggattcagggagagtggatttggtgggagagagtagtctaggatgaatccaattgggtttttatgagtagtttggtagttggttgactgggtgggtggtcccttggtaattatttgttgattagtggttgttgggttaggttggttacacttacattatagtcgatggaatctcagatttggatctaataccacatgtaagtcgagtggatttttttttgagacagagttttgctcttgttgctcaggctggagtgcagtggaacagtctcagctcaccacaacctccgcctcccaggttcaagcgattctcctacctcagcctcccgagtagctgggattacaggcatgcgccaccacgccgggctaattttgtatttttaagagttgggggtttcaccatattggtcaggctggtctcgaactcccgacctcaggtgatccgcctgccttggcctcctaaagtgctggcattacaggggtgagccactgtgcctggccagttgagtggatttttttagcactcaagcttcgtggctcattgctattattgtgcatgtgagcgttttatctttcagtagcattagggatgctacttggatgtgttttagttattacagaaatagtttttactaacttttactaagttatctttcctctcctgtgtaggaagtttagagtgaagcggcagttggctggaggttctgaaggtttccccctttcacataatttgatgttccagttgcccacatcaggacgactccctctctttctactgatgtaagcagtgggccaaattatggggctccatccctgcatcttcctacttgtctaaatcttcgtcacagacaacatattgctctaaaggaaacctagaaaggaggagaagctggttttcgcccaaattcctcaaaatcatcgcctgttgtttaagaattacagtttgcactggaacaataagatgttccttaatgtggtttttaagtgagttggttgtcgcctgaatttcataaacactggctaaggattgtgcaaaagggtgtgcttccctttagcatccttaattagggacagcgttttgaaaactgctttttattgtcctttatctgcaaaacttcttgaatccaaatagcgagattctcatttcttaatcactgccacagaaagttgtagattagagaaagctccaattccttatttcctgtcttcctttctttctgtgtgtttattgcctgtgtctcatcctcactcctgccagttttatagaatgtaacctcccagcctctgggaatgtttgggagacttgttcatagaggatctgaagagcagtttaaagtggacttacccaaactatcttctggagaacattagtctctttggagataaaatttttaaacatccgctagtccaatagtgttggcaaattccctgtgacactgtagccctctctttgagattgtcaatgtacgttggcatgttaaaggctctgagaagtcctgcagcagttaaaaaattgtttagtctagtgtgcccccagttgtttggccactgaaacccccttttctggaaaaaccagctaacatctggtagtcttttctaagaggtggtactgaagatgatactcatgttacacatttaaaaattctaacatgtgtttttcatgtgtttataaaatgcaactaatgtatcaaacctgtgatttccaggacataattacttaagctaaggaaaaaagaaaacatgagtgaaggaaaaactttagtaaataggccaggtggtaagaggagagagccttgtctgtgagtgtggtctagggggatgctggacctagcttttcagagctaggttcaggcagagctgctctgagatgtagacactgcagctggggttcttgttgagccgggaagcagcttctgactaaggtgcagactgtttagatgagctggtcataaagagccctgactgtggactgygtctccagccacggcagcagctggtggatggggtgatgccttggatatttatcgtgtgtttcttgcctggcctgcccttggacagtgcgcctcaggaatgttagaatgtgttccccctttagcagcaaagccgatctgctgtgtacttgttctgtttatcttactgccacgaccgtttatcacgggccagagttcaggggcacactgataaatctcttttaggaggatgatgtaaccctcagcattttccycctacttggttctgagtttttaaagcttttgtaacaccatcatgtccttgtttgggcatcttcctgtgtactcccgtttgggtctccagggtgaaatagccaacagtggattctggagtcatggcctgggttcaaattcctgctctgctgcttatcaactctgactttgggtttaattgacctattcattatttttcttaatctggaaaatggagccaacagcagttcctcataaagcagctgtaaggattcaggggggtaactgcacagggccaagccctcaggtttcacctctcactgggaggtcggacctctgcataatggacaagctctcctagggtgcaagtgaacgggggcgcaagggagttaggaaggtgggtgttttttgtttttgttttttggtggcttgaaaaacatgcccaaggctgggtgtggtggctcatgcctgtaattccagcactttggaaggcagaggcgggagcattgtttgagcccgggagtttgagatcagcctgggcaacatggtgagaccctgtctctctytttttttttttttttttgagatggagtctcgctctgttgcccagactggagtgcagtggcgcaatctcagctcactgcaaccttcacccccaggttcaagtgattctcctgcctcagcctcccaagtagctgggattacaggcgtgtgccattgtgcccagctaatttttgtgcttttagtagagatggggttttgtcatgttggccaggctggtctcgaactcctgatcacaggtgacccatccaccttggcctcccaaagtgctaggattataggcgtgagctactgtgcctggctgacccaaaaaattagctgggcgtggtggcacacacccctgtagtcccagctacttgtgaggctggggcaggaggattgcttgaggccagcctgggcaacagagcaagaccttgtctcaaaaaaaaaaaaaaaaaaaaaaaaaaaaagaaagaaagaaaagaaaagaaaagaaaagaaaaacatgcccaaaggcaaccaaatgactccatcttttgcaatgtaatcttcaacatcgactcctctggcaagctgtttggaaatggcaaagtccatctcctgaggctgggagattgcttgtccaggacgggtgtgtctggtgaggaatggaaggcatttggatggccactgagaaagctgagccaaggagcatcagaaagacaatcaggcaaacccacagagtctccaggtattcctttgctgataggtaacattgcactagcgatttaaacaaacaggtgaaaggccattgccctaccaccccacctcacctctattccttgctgctctttccagaagcaactgcatggtctgggaacagttttttgtcttgtcaagagacagtctgtacatagatgaattcaattatattacttctgtagtaccctgtactcaaatttgaacctgycatacacattgcttttatcatttcataatacctgttgattttcccacgttagtacctatagatcctgacaagcaattttgttaagatgaagagttcttcatatgtattgtactatgtttctttttttgatgatgtatgtcaagatttattataaaagtaacagatgggtagggcatggtggctcattcctgtgatcccagcactttgggagaccgagatgggaggattgcttgagccygggagtttaagacaagcctgggaaacctggcgaaatcctgtctctacaaaaattacgaaaattagccaggcatggtggtgactgtcccagctacttgggacccaaatgtcccagatactcaggaagctgagtcgggagcctgatcctcagaggtcgaggttgcagtgagccgtgattgcaccactgcactccagcctaggtgacagagtgagaccctgtctccccctggcctccaaaaaaaaaaaaaaaagtaacatatgtagtttaaattttaaaaattaaatttttgggggggctgggtgtggtggctcatgcctgtaatcccagcactttgggaggccaaggtgggcagatcacctgagatcaggagttcaagaccagcctggccaacatggtgaaaccctgtctctagaaaaacacaaaaattagctgggcatgatggggggcgcctgtaatcccagctacttgggaggctgaggtgggagaatcgcttgaacctgggaggcggaggttgcagtaagccgaaatcatgccactgcactccagcctgggtgacagagcgagactccattaaaaaataaaaataaaaaatcaagcaatgcagaataaataacaacaataaaatgaaagcccatcttccaccatcagcttcttagttttcttcctagaaggagccagtgaggacagtttggtgtttatgcttccagatctttctgttcagatgcagtcatgacttctgaaaaacaggattgtacaattcatacttttctacaaattatccccttcccttaatacatcatagaagcctattcatattggaacaaacaaacatttcttattcttttcacagcaccctgttttcctcttgcttgaatgtaaagtttatttaaccacttactgtcagggaggcatttgttttcagttctccctccctccccccaccagttgtcttgtaatgaactgctttaatggctaaagatcactttaatatcaaaacctcccccacctcccattagaaaaagaaatcatrttagggaacttcaaattgaatttacggaccttgtgtttaattttctatcagcagtggccccagcctggcccctgcagactgccccggaatctgtgggaggagttggggtggcctgcagactagagcacactgccagttcattcagcagctcaccgagcaagaaacatcttgattctatcagccttaatgctgtgtcccattagggacccagctcttgtggtcattagcagatggaatgctcatctgtgctagaaggcggaattctagggcattcggctctgagcagtcttgaaccagaattgaatggcttgaatccttttcacaatgccaacggggaggcacccttagctcccaaacttgtgtgtgttataatactatggtagtaataacagtggttgtagtagcccccgtgaatttgatgggacagtcgtcaggcagtgctgcttgcttgctttactccatcgtatcaccgcagcctgatgaggcgagggagttacgactctcattttgcaggtgaggacactgagcacagggaatcgacccactcatggtcacacagcttgccaagtcgctgtgcttgggaggtgaaccaggcttctctgacgccccagcaggacgtctgaacttctagctgccccatcactaactgacttaatgcccctgactcctgggtgacttggccaccagttacttcagccagcgacctgccctttctttgagtgggttccacccatccctgcaccatgccttttactttggatgttggtggcatggaattccacccgtaagaaggaggtcggtccctgggctgagagagtttgcagagagctctgttgggattgggtgggacgtgtgtttggaggcctcctcacataattgtgggctgaaaggtccagatttggggatataaagttgagccgtcagctgagctaaagacagggcacagggaggagccatccagaaagtgtcagtgtaggtaaagcaggcagagttccccctatctgtcctctgagggcctcctttcttgtggtttcctcccttttctgtggtgatggtcagagccagcggttataaattatttggaattttcctcagcttggttcctactcaagactttmaattaggagttttgttcccttttatgacttcacaatctttgggcaggctgccatctctacagcaggctaatatgagttgtaacttgaggtgagttacaggggaaaaatggaagctgatttctccccttttaaaccaaggaagccaccttgatctgactttgtaacaaagctcaacttttgtaagtttgcaattaaaggataaatacctatcctatttattattattattaactttttattataaaagrggaaaaaactcccaggaaacatagcctaatatgagggacaaaaagccaaaaggttttttttttcttcctttaaaaggtcctcaatgtcttgccctgtggagacaccagttttcattataataacgccattatctctttgtagagtcatttcaagccaatttaactttctcatttaaaagtataattggtattcagcacagagctgggagctcagtaggcagttagaaaatatgtgtatattttttgagacggagtttcactcttgtcacctaggctggagtgcagtggtgcgatcttggcttactgcaacctccacctcccgggttcaagcaattctcttgcctcagcctcccaaatagctggaactacaggcactcaccaccacgcccaactaattttcgtatttttagtagagatggggtttcaccatggctggtctcaaactcctgagtttcgccaggctggtttcaaactcctgatttcaggtgatctacctgccttggcctcctaaagtgctggcattayaggcatgagccacagcacctggctggcagttaggaaatatttattgaatatgagaaaagaaaaatagagcaaattgaatcttcaagtagtatgtgagtaattctaattcctgttttctggaaaacacacaggctgataggtttgggtaaataagagcagagctgcatcttctctcaagttccctgattccctcaaggagttacctgagaatagctctgtgccaagcagtgcggcatgcataggggacctcttgaatggagggacagtccattatcattagaatccccagttccagccaggtgcagtggctcatgcctgtaatcccagcactttgagaggccaatgtgggcagattgcttgagttcaggagttcaagactagcctgggcaacatggcaaaaccttgtctccccccgccacacacacaccacacagacacacagacacacacacactggctaggcgtggtggcaggtgtctgtagtcccagctacttagaaagctgaggtaggaggattgcttgagacttggaggtcgatactgcagtgagctgtgatcgtgccactgcactccagcttgggtgacagagcaagaccccggaccctgtctcaaaaaaaaaattccccagttctcagggtgtggtagaggccgagtcagtcatggctgagacaaggggactgtgctctgtgtgctyctgtgccctgtgtttatatggttcatacgctgcctgtccaccatgtttttcccgagagcctcggcagcgcaggcatcatgggaatgactgrgtcaggtggaaattcagaggccctgccctggtgggcagagaagcctggcttacctcccaagcacagcatgtgtgtggatcacttctgtgcactgtctcctcatctccaaaatgggagtcataactgaactcacctcatcaagttgttatgagatgatgtagattcagcgaagtagcaagagtaggagtttgggctttgataacagagagaagtgagtttccatctagattctccccctgtgtcacttttggcagttggcttcacctctgtgggcctctgttatgtcatctgtaaaatgggattaaccctaaaagccaccctcacagggtcattgtgaggattgcacraggtgatgcaagtggcacagggtctggcccaggagagggggctggaagagagcgagctgccattgtattttggttgctgtggatctaaggagaagagatgtttaggagtctttccctggcatggttcctcctgccttcacccatcactcttttcctcgagggattccctgtggggtgcacagccccagggtgggccagactgagctcacaggagcatgggctgtgtttcaggtgaggtggcctcaccacatgacaaactgagctggagtcaaagggtcacgaggacctccattcacagccagcatttattatttcagctggaaatgtttgccgagcagttgtagctggaagctgtgagcgagacacagactgccatcaggctgaggcctccagagctcatgctgggctttaacctgagcctcttgggggctgggctctgagctcctccacttctgctcatgcccaggcgtccttgggggccttgaactgtcagttgtccaggagaactgtgtggcagcaacagaatgagtttgtatagcaacctgttgctttgaggtttaaaacttagtttagaacgcaattgctttgaccattttggagtgtctatactttttttcttcttctttaagttttcttttttctttttttcttttttttttttttgagacagagttttgctcttgttgcccagtggcaacaagagtgcaatggcgaaatctcggctcaccacaacctctacctcctgggttcaagctattctcctgcctcggccttctgagtagctgggattacaggcgcccgccaccatgcctgaccaatttktgtatttttagtagagacgggtttcaccgtgttcaccaggctggtctcgaactcctgacctcaggtgattcatctgccttggcctcccaaaatgctgggattacaggcataagccatcaagccctgcttttttgtttcccttcttcgacctttctaacaagaggttggaatcctcgttttgacttttaaaggatttcccagtgctagaaagtggtaagatagttactgtatcctaggccctttagcagacctgtctcattgatcatttatttagtccagtgtggctttgttgttggatattaagtaattctcaaaattttaccttttcaaaagtggcattgaaaataaaggcattgggtgatgaaaatggaacttttaaatacagtgattcctgttaaccagaaatagggtgtttgggataatttatgaagcagtacaccatcatagatactatgagctgaaagttcaccaaactctctatcccaaaataacaataaggtatttatgaagtgattcrttccaactatttgaggcaaaaattgtccagcaagtgagagagaacagaaggaatagttggcaaaatagggaatttgaagtctgaggttatgcataaggaatgtgttatgggcctatagtagaaatctcaaatcagggattagggaatgtttactcagttctgttgcagagaaatcctggccacgactcccccatgccatgcccagggcaggcattgctaatcttcactgcctccattctccatgccctgttcacggaagacatttctaatgcattttagcagtcttttttttttttgctgaatccagatgtggcctcagaatccttctcaacacagtgtactagcaccacttggtgctcctgatctactgtatcatctcttgaaaaactactaacatraaaagacctgccaagtcaactttatattaactgaacccttgacacagtgatggataaaaattaattcaaacagcttctttgtgatctttgagtagttcatgagcaagaaagagaattggaaatccagccaacttcggccsccttgtctacttgtattttactgtggtttatgttttctcttaccaattgagataggcccatgagacttctggtcttccaaagcccagaacatccccacattatagtttaaccactgtaacaaagaggttttttttktttgtttttttgttttttttttgttttttttttgggacagaatctcgctctgtcgcccaggctggagtgcagtggcatgatcttggctcactgcaagctcygcctcccaggttcacrccattctcctgcctcagcctcctgagtagctggggttacaggcgcccaccatcacgcccggctaattttttgcattttttaatagagacggggtgtctggatctctgacctcgtgatccgcccacctccgcctcccaaagtgctgggattacaggcgtgagccaccacgcctggccagaggttttcttaaaaacaataacaacaaaaacagttgtggaaagcatgtagagtgtgggttttttcggtcttcaggttggcagggcatctgatactgggacccaggttccttccctcaccttgctgtgcctctcctagtgcaggccaaagccaggtgactgcgctgtctgggctcctggctggcaatcggggaaagagtgcatggagcaggcatgcccactgttcaggtcctgaagccgtggctcatttcatatcatttgttgcttatttgaaagacaggcacagcactgacttccaggggaggctgactgaccatctaggtggaagttgcatgcctgggagggagaaggggacaaaggccacagataggcatcagttatcagggccttaagtctgccttgttggcatgcagccttttattggatcaaggccctggagaaaagccctgagcaggaggagataagccagcttggtccccttcatcctacccaggggcctctggggtacctgagccaaagtgcacagttcattggctgtgtggatggaagggmtatgggacttgaaaatgggacactggtcctgggcagctgaccgacatggtcctccttaacctgctgtctggggagatgggttgcatctggctaggttttgactgaggaactgaggagagctgtcagctgtccccgctttggttcagaatgcccttttgtttggacagctgaagcctacaattcagccatggtttgtttgggctcagaaaacaggcaaggatggagagaaactgcaaagctgacctgggctgtcagtgggcaccaggtcctgctggcctggggtctggatgcaggagatctgagctcttcaatgtggggtggtcttgcagcagctcttcacaggctgctgctgctgctgctgtaggctcacccaagcagccaagacggacaggatctattctagttttgtgcagagttggatatagaagaggcattagagggagaggggatggggaaggagttccaggccaggtgagcatggggcacagtaaactgggatgttaaggaggggccagtttgtgaccagcctgggcaacatggcggaaccctgtctctataaaaaattaaattagccaggtgggtggcatgtgcctgtagtcctagctrcccaggaggctgaggtggaaggatcrcttgagcccaggaggcggatgttgcagtgagcagagattgtaccattgtaytctagcctggatgaccgagaccctgtctttaaaaaaaaaaaaaaargaggggccagacccctgacccatatgtgctgctcttttctttcagggaggtctgataaaatatcagtagttcaattctttttttttttttttttttttttctgagatggagtcttgctctgttgcccaggctggagtgcaatggagtgatttcggctcactgagacctccgtctcccaggttcaagtgattcttgtgcctcagcctcccaagtagctgggattacaaggtgcccaccgccatgcctggctgatttttgtatttttagtagcgacagggtttcaccatattgtccaggctggtctcgaactcgtgacctcaggaggtcctcctgcctcagcctcccaaagtgctgggattataggcgtgagccaccatgcccggcccatagttcagttctttaggtggttcttggtgctgcatatgagatctctgcaagaaggacacgtctgagccgggtggtttagaagaccagcatggcccaagaccctcagagcaacaccaagaaccacctaaaattctttctcagacgtgtccttcttgcagagatctcacgtgccccaggttcgctgcagcgttaggrgtcagcctccctttggagcaggagagcaggggccttggaggtggcagtcatggccctcctaattaattgcttggctcagagaagtgacaaattgaacatttcaaccacctgttaattcacaaggtacttcttttcatttcttgctgcttgcacaaaacacttggagtatggcttgtggatgtctggccctagggaagagtgtttggcacatagcaggtacttaagtattaggaaaatgaggatggaggggagggagggaacattattaagcggccaactgtgagacaggcattgtgcttgactctttctttctttttttttttttttttgagacagagtctctttctgtcacccaggctggagtgcagtggtgtgatctcggatcactgcaaccgcgcctcctgggttcaagtgattttcgtgcctcagcctcccaagtagctgggattacaggcgcctgccattatgccctgctaattttatttttagtggagacagggtttcaccatgttggccaggctggtctcgaactcctgacctcagtgatctgcctgcctcggcctcccaaagtgccaggattacaggcgtgagccactgtgccyggccgacacttggcattctctaacctacctactccttataacagccctgggaagtagttgaccatggccatttctatttggtagatgaggaaaaataaggttcagagatggattgttcaaaccgaygtatctagtcaagctactggttccygagcctgtgtttgcaacccctctaccatgtagcctctccgggtggtagagatgagggggcagagtgcacagtgcatggcatcctgttccccagatggccaagtcttagtgcgagtgtgtgtggccttggtaacttgtgtcaagcacacaccccatctctctctctctctctttttttttttttttttgaaacggagtctcactcggtcacccaggctggagtgcagtggtgctatcttggctcactgcaacctctgcctcctgggttcaggcgattctcttgcctcagcctcccgagtagctgggactacaggcacatgccaccacgcccagcaaatttttagaagagactgggtttcaccatgttggccaggatggtcttgaactcctgacctcgtgatctgccctccttggcctcccaaagtgctaggattacaggctctcttgctctctctctctcttgtttttttttttttgagacagagtcttactttgttgcccagcttggagtgcagtggcgtgatcatggttcactgcagcctcgatctcctggctcaagcaatcctcctgcctcagcctctcaagtactagttggtactaatgggcatgcaccactacacctgactaattttttttattatttgtagggacagggtgtccctatgttgcccaggctctggtcttgaactcctgggctcgagctatcctcctgtctcagcttcccatagtgctgggattacagagatgaaccgcctggcctacacacccctatctctcctcgattcttttttttttttttttttttttgagacagagtctccctctgtctcccaggctggagtgcagtggggtgatcttggctcactgtagcctatggctcccaggttcaagcgattcttgtgcttcagccacccaagtagctgggattacaggcacacaccaccatgcccagctaatttttgtattttgagtagagacagggtttcaccgtgttagccaggctggcctcgaactcctgaccccaagtgatcctcctgcctcggcctcccaaagtgttgagattataggtgtgagccaccatgcctggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctggatggtttggtgcaggaatgtagtaggcatacacgtggttgcgtggatctgggccctcctgatgtgagtagagaggtaaaaggccaccatctccttgacctctggggaannnnnnnnnnnnnnnnnnnngtagagacagggtttctccacgttggtcaggctggtctcaaactcccgacctcaggtgatccgcccgcctgggcctcccaaagtgctgggattacaggcatgagctaccgcgcccggccatcttgtttttgttgttgttgttattgttgttttgcttttcggtttttggttcttttttttttttttttttttttttttttttgagacagagtcttgctctgtcgcccaggctggagtgcattggtgcgatcttggctcactgcaacctctgcctcccgggttcaagcgattttcctgtctcagcctcccgagtagctgggattacaggcatgcaccaccacgcccagctaatttttgtatttttagtagagatggggtttcttcatgttggtcaggctaatctcgaactcctgaccccaagtgatcctcctgcctcggcctcccaaagtgttgagattataggtgtgagccaccatgcctggcctctccttgattcttacagtcactttgttggctgtttctgactcagcagctacctgcattgtggccaaaggatgacctattccttctcaggagggcaaaaatgtggaatagtgtctgtccatgcctctcctcatgggctaccacctctgccaccgtggttaatcagtaacaaccaggagagaagctgctggaactgacctctgggaactccctggatggtttggtgcaggaatgtagtaggcatacacgtggttgcgtggatctgggccctcctgatgtgagtagagaggtaaaaggccaccatctccttgacctctggggaactcatccacaaagaagatgtttccaagatgcttctgaagattgcctaaaaatagcckgtttccacccccgtgaatgcatccattctagaatgctccttcaccaggaccagagaactgatttacagaagtgacatgaaaacattccatcccagaatttgcagtagctcaaattaagtttctagctattaaaaagaaaagaaaayaaaactaaacaaaacacacccaccctgctcacttagaagcaacactgagtaattttaagtagttcgagaaaatgtatgtggtttgagggtcagggttgtccagagccaagaccagttatgtgggaattgttattggctggatttggggaggagaaacccatggcccaattccaacccactgaaatctaagcagattctaggtggttaggcggacctggtaggcgttggtttattttattcccgaaaaaggccctggagcaagtcttcacatggaatcctgctgaaaggcttccggctcatctggccttttcctcctcttaaggttctgctccatgttttaccctcggcgtaaacattgcagagcacgttcagatctgaaaagtgtctcatctacgtgatggtcagacgttgttgaccctgtgatgctgtgtaacatttcattttcgaggcttggggagtctcctatttcatgtggatgggaacctggaggtctttgggcaagtcgccatctttttattgttccaagagtttggtgaagcrtttgaaccttcacctgtcaaaatcagttttggaatgagaactgctctctctctagtccttataatagcagaaggaaggtatcatttatcccaatgagaccataaagggggctttcccgtgtggacacccaccttgaattcaattggaaacagaaattctgggcattgtattttttgtaaatttggctcagacttcaactggatcatatttcccccaaaatcttttcgaaaaagacttgtgtctcattcctttagactagcatgtgtaagctgggtaaaaatagagcaagccgatttcatgttaatgatttcatgttaggtttgtgaatcaaatctgcaagtctgcttttgaaaagcatttaacatataacttgggaaagtttgagttttgcagactaatgcctgtggccggatgagacttcatagctccatccaatccctcctggtgcaagagatcaatgccttgagggtgcctggccaccaccattaccctgacagtatacccactatttatttatttatttatttatttatttacttatttattgtttacccttttgaagattgctcttctccctttaacttaaaggaattggcatggaaacttgtttgatctggaatttctgataatcagtaggtagtaactccgtaatcaatagcacttcaaaacaacaaccaaataacaggataactaatccaaaaaattcagtcatggtcaaggacttccagctcaggaaatgtctggtcccgtggggtggattccttggataaccaagttccgtgcagggcctggagttttatgcagaccattgctccttgattgaccacaggacctcaaaaggagggctggcttcatgaccacatgacccgtgtgctcagaagggccctgtacttggtttattgctctgctgttgctgtcttgaagttcttaattttttttttttttttggcactggggagttgcagtttcaaacaacacttattcattgtctcacagtttctgtgggccaggagtccagccatggcttaagaccaggtcctctgctccgggtctcacgagactacaaggaaggtgccatctagggtgtgttttcatctgaatgcctaactaaggaaaaatccacttcattcaggttcattcaggtttttaaaagaatccatttctgtgtgattgtcccactgacaggtcccagctttttactagctgttgcttggaggctaacctcaggttttacaggctacgctcatatctctgccatgaggccttctgcataggcaattcataacacagstgcctgtttcctcacagccagcaagagaatctgtctcctgtctgctaaagtggagtttcatgcatcgtaatatggtcatgggagtaatagcccgtcacctctgccatttttctgttggttagaataaaggcacaggttttccccacactcaggaagaacccatgatataaaggctttcagtaaaggagacgacaaacagaatatggaatgatcagaattactcttatgacccagaccaagaacatcagcattacctacgaatttattggaaattcaaattctcctgtttcaccccaggcctgttaaatcagaaactttaaaagcgagcccagcattctgtggtttaacagatccttcaggtgattctgacacctgctgaattttgagaaccactggtctagaggcaggcaggtcttgctcccctaggagttaagtttgatgtatcttctggtaatactgagaaatgagctgggaaatggttccaaaatcagattatcctccccaggattaacaagactcatacttgcaaaagagagtgaagaagagaaactaaaaaaagcaagaggctgtgtgtgaagctagattcaaacagttaaagayagcaacacatggcaaaggatgggaatttgaggaagtgggtagtgaaagcaattcttgagctaaattacaagaaaacacggtgaatttgtatctgtttcctatatttagggggctggcttaaacgttagtgatacatttggggagtagaaaatggatgttggtgtgaagttcttaagttttggacaaggaaccctgtattttcatttttctctgagccccatgaattatgtagacagtcctgcttcgaagttattatttatacaattcattatagagaaagtccttgggaaccttaactttgagtgaggattgcttgagttagtttttcttaccagccactccatgatactctttgttttttccaggttagatgatcgagttttattatgactgaatctgcacctgcaaaattaattctgattaattaatttaataattaaattctgatgatttctctctgatggtttgggtgtgggctcttaaagagggtctttttttgcaagaggatataacaataatcaggttaattaaaaaaataaggctctcaccctttcatttttgagtggcatgccatgcaccccttatcagcatgtgagtatgcttttcatgtggtcgtggttgggtttcattaagtgtaatttggcatgtgttcaaccagcattcaggtggctcttggtgggtggctggggagacaccaagatgcagatagctcagtcactccycaacaagcggcttagttctggaatgaggtgggaggccaaggaactcacacataaatgctggtgggagtgaagtgccaccagctgtagaatctggtgtcagaatgatgagccaggagttatcccacaggaggatgggtgaaggtcttcccatcaaagggatagagaacatgtgaagaggtccaggggctcagggcaagatgtagtccaggaacaaggagtctttgagcctgcagtatggtgggtggaagtggcaagagtggaaagcggattggatggggkttatgtaggttctgaggtgctgtgtatgtttaaggagctgaytgtgtgcagcgggaaccctggtgaatttggaagcacagaggcacctgacgagaaagatggttctggggttatgtgaacagtgattcggcttcaaggctatcaaagacaaaaatgtttattgggagggtatagaaaagggtttgccaaaagagttaggtagggatagaattgacacattgtggaaactatacccagagtttaagaggtggagtccaggatagtgcccatgtttgtagcttggggtcctggtagaatgggagctggctatggagtatctttgttggagagtgggtatagggaaacrgagagagagagaaagttgcagggggtgcgggagatggatagctgcagagaaggcaagggcagggaaagtggaaacaaatggcagtgagactcctggaaggtgctggccaggggcatggcatggcatgttctgttaagcaaggraaggactagaaaggggccatgattttggctgggcacttatcctcctcacaacaggacgcatttgtgtcatggcttactcttaagaatgactgacgtgtcagaatagcaaatatgaaaatgattgataacacctagcattgktgagatttgcagggataactagctggcctcttaaatctatagataggaatgtaaacagaaacaaactttttatagggaaaagatatctaggacataatgattaatgaaaagaaaaaaattcctacctatcgaaaaacgtgaattcaggcagcaaacacacatgcatgtatacacatacacacgtgcacacacgcatacacacacaatctggtaggctgtatactaccagtttagcaggttgttacctctgggatgcagtcactcctttttgttgtgtatatttgtgaaatgatttctttcaatttttgagacagggtctcactctgttgcccaggctggagtgcagtggcgtgacgtcagctctctgcaactttcacttcccgggctcaagcgatcctccaacctcagtctcctgagtagctgggactacaggagtgagccaccatgctcggctaattttttttttttttttgggtagagagggagtttygccatgttgcccaggctggtcttgaactcctaagctcaaagcaatcctcctgcctcggcctcccaaaagtgctggggttacaggagtgtgccactgcacctggccattattatggaaaattttaggcgtatacaaaagtagagacagtggtgtcttacatgctcatgaacccatgatccagtgacatccgttaatggcattttggaatcatatttcatctgtttttgtcctcaaatgttttgaagcaaatttcagcattacatcatttcactcttaaatatctcagtatggttctctaatagttgaagactccatttacatttatataaggwgcataatttacacttgtgtaacccaaaggaatgaccaagcctgtgcttctctccccagatagcaaagccattgtggatgggaacctgaagctcatcttgggtctggtgtggacgctgatcctccactwctccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacrgctgtgctccaggtaagtggccagggctgcctaaaccatctgtccaggatgggggtgtgtgggtcccaaacattctggttttcaacgggaatgctatctttgctttgattagcgtatttctccaggtcttagcccattataagcccattataaggaaactaaaactggctctgtgtacccttccaagggcagattttctaggtatatccatagacatgtttgagcatcaagttgagtcttttatccaaattccaatgaaggagttggtgcttagaagcaagacttgggtttagsttccasactccaaaatcctgtgtcttcycacattggtgctcagtttctcattggatttggagaaacatttggtcctattaggtggcttggcatgaaaatctraaaacttccatggagtggaaagtacccatttttattaaccactggtttgactatatatggcattctccacccttttctttctgtgttgctgtgaaatagcatttggtcaggatccagttggagccttttccacccttgatgggctgctcatttcttagtggttgagtgtatatgaaggttgtaattattcccactggagggtttagattgatgggtagagtttgctggtacacactcagtagaaagaccagagtcagagtttacacacaccccctaaagttgattttaataaaaaaaaaaggtattaatcatattttccatttactgtgtattctgtatttactgggcacattagtatttagttagttagtggttcttgacatactcaaagcagaactagtgtcagttgggtargggagggctgaaggcctcattcttacttgagagcctataagttggtgtcatccaggaaaaattcaaagtgcagcattaattgatttcctaatatcctcttctttacttccatttaaggacacattttaggatacctctttcyaatttaaacctgggagtttttactctagtcctttacctcatgtgcttacaaaggcttttaagataattctaggtttgtgcctttgagcaagtggatttttgaatcacacaggatgctattctagactttttagatatatccaggaatagagtaaaaaataaaatccctcctgcataaaggcaccaggctttttccaagctttgtttattttttaacaccacttcttcaaggaatggataatccccatcttcatgcaagaacatagcacccggaggagaagtctcagtaatggaggatagtttacaccctggcacactcatacctgtgatactttttgcctattaaatatatgatttgctcagattttaggaaaaaatcattctctgaactaaaagaaaaaatggggttagtttaggcacatggtttcctttaatctctttggtcagctaatgctaaaagaatcttttgtgttctgttaacaggtctgtgcccagactgggaatcctgggacccgcagaagcctgtggataatgcacgagaagccatgcagcaggcagatgactggctgggtgtcccacaggtatgcacaagtgtgccaggtcctgtgaggctgcccccacccactagcttgttctgtggatgccttcccgggtcaggcagcccgaccttcttggcattgagacttcagagagcattgcctgtgatgctctctcatcttcctcagtttacccataataatagtaggttctcattgactcaggtgcttatagatcttagtgtgttggtttaatgtagatcatccagaaattttcatgtcactcttctttgtcacacactggcaaattttctagtatttcttctctaaatattttgaagactacctttaaaccccagactacaaatatggaccctaactattaggttgagccataagaaattgatagtatttgaccatttttcaatctacattttaaaaggtaattttaatccaatagcttaagaaaagtcacaggacttaaaatttttttttttttttgagatggagtctcgctttgtcgcccaggctggagtgcagtggtgtgatctccactcactgcaacctctgcctcccgggttcaagcaattctcctgcctcagcctcctgagtagctgggattataggtgcgcaccaccacacctggctaatttttgtatttttagtagagacagggttttaccatgttggtcaggctagtctcgaactcctgacctcgtgatctgcccgcctcagcctcccaaagtgctgggattacaggcgtgagccactgtgcctggccgacttaaaacttttaaaaacatgtaagccaggataatccaccattaatggaaactgtggaagaatctctatcacccataatcctatcacaggaatataacaagagaactcagaaatcaaataagtcttggataccatctacagtagtcacattgcttagttgaagtctgatcttcctagctgggaggaaaaccagtgttttctttccagaaactccctctaacagttaggcaccatgagtcccgtgtccaaaggctagccagggaagattgcaggtagccagtgccatgggactgatggcgtcactataggctgcattgaggtctgagttcagtgtattttgtaacagggtcccttggaaggtagaacaacatgcctgtttctttggtttggttttggagtcatgtctctcctacatggctcattggtttcttggctcgtccaccctcaggaagtggtgtggtgtgtttttcatctccgcttaaacctaaaccgtctcctttttacgttcacgtgatgttggcatgggtgaagttgttgaaggagctgctgggaagaaatgccaaatcgacacacatcctactttttatggaatgtattgaaggcgactgttcaaacccaagtagctcttttgttcctgcaggctaatggtcagaatgttttctggtgctttttatcacatggggagggaagttggacacatctgttgttcattgcacatggttaacctggtccatgagacagagcctctgttcatctgaggaagtgtgatttacctccttagcaccattactggaggcagggaggactctgcaagctgtttagggctgggtcagatgatggtactgaaactgaggtggtggcaccttcagggaagtcacctgtccaggatgggtctagtcttgctcctaagctgaatatcaagagaagttcacccattccctattttttttttttttttttgagatggagtcttgctctgtcacataggctggagtgcagtggcacgatctcagctcactgcaacctccgcctcctaggtacaagcgattctcctgtctcagcctcccragtagctgggactgcaggtgtatgccaccatgcctggctaattttgtatttttagtagaaatggggtttcaccatgttggccaggcttgtcttgaactcctgacctcgtgatccacccacctcggcctcccaaagtgctgggattacaggtgtgagctactgcgtctggccttttttttttttttaaagagacagcgtcttactcctctgttacccaggctggagtgcagtggcatgatctcggttcactgaaacctccacctgctgggttcaagccatcctcctgcctcagcctccctagtagctgggattacaggtgtctgccaccacactgggctaatttttgtatttttagtagagactgggttttaccatgttggccaggcttgtctcgaactcctgacctcaagtgatttctcttgtcttggcctcctaaagtgatgggattacagtcatgagctaccacgcctggcttccctatttttttaatggctcctaatatattgagatcacatatctaatatttacatgttatttcttttttatttaccttttttaattagtagagttaatacagatacagaccatgagtatacaagcaaaggaaaaagctggttaacctgtgcacttttttgtaacatgctctaatcccatgtgtgcttgtttcttcattttcctgccttgctatagcttatccttttatcatttttgaaattttgaccagaggagtaaatggacttttggggaatggggaggacaatgaacttttggaagttacatgcagaattttttggagaggggcccctagctttcaaaggggtctgcaatttctcaaaaatggttaaaaacactgatattggtgtgttggtttaaagtaatttcacttaattgagaagctgactcagtttcttaatatttgtagtgcttggtttaagaggcatttgcaaacacttcaatagttgcaaagtgatgtgttctgggtgttcatccaccatgtcattatcctaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggtgagtgctggtcctctggtgttgtattggagacatgtcctctggtgttggagatgatttcatggcttcaagagtgatgttcttagaatcaaaaatagataggtgtaatcctcaaagagaccccaagcctcctttgtaacacattttatgactgttttattctgccttgtttttctaaggctttaagaaatgtttctgcttagatggaaagggcaagtttgctgcttggtgattttagtgcagtagcccattgctcccatttttcagaagaggaatcgcggggtagggagtygggggagtttggtcttgccccagatcaccacagtcagtgatgggggtgggccatctggctgctgattcatttctccttctgttacactaagcctgcctcagatttccagccggagtgggagctattgttaacccctggcagatacttccttgctaagacatcctgtttatgactgcgaggcagctgcggaacaccgttttgctcagaacattatagtgggtagaagccatttcaaggcatttggtgttgtgattggcacctgacttcaagcacactagctttgtgaagagaacagttacatggctgcaaagtgtggtttctggtgaagatcaacatggccagatacaacttaatgccttttctatgggggaggggaaggagtgcattttatttctcatttttcataattaagaaaatatcggccgggtgtgatggttcatgcctataatctcagcactttgagaggccgaggygggcagatcacctgaggtcaggagttggagaccagcctggccaacatggtgaaaccctgtctctacaaaaaatacaaaaattagccaggcatggtggcgggtgcctgtaatcccagctattcaggaggctgaggcaggagaatcgcttgaacccaggaggcagaggttgcatcgagccgagatcttgccactgcactccagcctgggtgacagagtgcgtgagcctcygtctcaaaaaaaaaaaacgagaaagaaaatgttatcccagtgggataatagttatacacacagtattctgtatatcttctcccagaattgacagttgttaccattctagcttaatagttttctcttgccctttgtgtgtgtttgcatatgtgttcatgtgtatgattgctgaattatttgaaaataagttgcaagcatggtgacagttctgtcctcagtacatcactaagcttctcctaagaataggatatcctctagcataaccacagtattcattgccacatgtaagaaaattaacaatagtttcatataatctaatattcagtttgttgtagaatttctctattgtcctaagattatcttttatagttgttgctgttttacaaactaagatctgattaaggttcacttactacatttgtttgttatttctctttagactcttttcatgctaaataatttccccaaactttttttttttttttttaaatgacactgactttctgaatagttaagggcatgtgtcttgtaggatgttccttccctacaaatgttccctttgaataaagtattttcctgcttggtatcagcttagtcttttttttttttttttttttgagagtcttgctctgtcgcccaggctggagtgcagtggcacgatctcagctcactgcaacctctgcctcctgggttcaagcgatcctcctgcctcagcctcccgagtagctgggattacaggcatccaccaccatgcctggctaatttttgtatttttagtagagatggggtttcaccatgttggccaggctggtctccaactcctggcctcaggtgatctgcccggctcggcctcccaatccgcttattcttaagacgacacatggctagggcagtgatgctgaccacgtgctgttctcacctcagtggtcgrgtcttctcatctgactttttgggcatgatttagaccggcagatagttctggaacaaaccccttaccatttgaggttccgtttgcagtgggttgtgaggtgtgtgagacatcacttgtgttatgtagggactagggacttcaaagccctcctcccattcacagtcacttgaaggctggcatgtcctcactttctttaaaagtgctttctttggccgggcttggtggctcacacctgtaatcctagcactttggaggctgaggcaggcagatcacaaggtcagaagattgagaccatcctggctaacaaggtgaaaccccatctctactaaaaatacaaaaattagcttggcgtggtggtacaagcctgtagtcccagctactcgggaggctgaggcaggagaattgcttgaacctgggaggcggaggttgcagtgagccgagatcgcgccactgcactccagcctgggtgacagaacgagactctgtctcaaaaaaaaaaaaaaaaaagtgctttctttaaggcataccacaggtggtggctggaatgaggaatctctgactttaaaggttatgcttccttaatgacaaaacagttgcaaacaaccaattaaatcctttgtcaaccagattggtcaaatggactgaatctaatcaaggcatagtgtatgtttgtaataaccttatcactggccatccggcttccctgttgttaatgtgagacggtttcctttcacggtgctattttctagaaaatgatcacttgttatggttcaggaatgtggctggtcattgccatttccttcatctgcctcttagcaagtgtggtgcacttgtagaggaaacacaccctttwaaaaaaaaatttttttttatatgtgtgctttttgcatttttttaattgtgggaaaatatccatarcataaaattcactattttaaccatttttaagtgtggcattaagtgtattcacgttgttgtgcaaccgccactgctatccatctccagaactttttcaacttcccaaactgaaactccatactcattaaacaatagcgccccattctcccctctcctctgctcctggtaacctttattctactacctgtctctatgaatttgcttattctagggacctcctagaagtgaaatcatatgctgtctgttaggtacctcctagaagtggaatcatacgctgtctgttaggtacctcctagaagtagaatcatatgctgtctttttttctctggcttacttcatttgtcatatgttttcagggttcaccatgttgtagcatgtgttagaatttcattcctttttaaggctgaataatattcctttgtacgtgtatatcacattttgcttatacattcgtctgctgatagacatttgggttgttacattcttttggctattgtgaataatgctgctatgaaaacatgggtgtacaagtgctgtttgagaccctgctttcaattcttttagggatatacccagaagtggaattggtggatcatatggtaattctatatgcagcttatttttcaggaggaagtggcctcactctgctttttaaagtaggagacaaaatggtcatattaggtgacagggtcacaaggccacatgggtggggctgtgagatatgtccctgtcatgtggttagatgaaagccggggtcagttttggtcttctctgtgtgaccacattgcttcatttctgccacctgagcccaggaagagagaccgtttcatcttctagtttctaaaagatttgaaagtgttgttttattttttatttcctgattgtttaatagatgccagttgccagccagttagcatttgttgatccattcactgagtcccaccttgcttagttctagtgggttgaaaggagagagggctggggtgaggtggacctccagccacaaacagatctttgtggtgggcttccttgcagggttagctatgtgaaaagcattcgtccatgagctaatcagaaatctttgtaaaaatctagttctctatgaagcatttactgtagagcaatccttaagcacccttctatctgagtaatcagaggggtaccagttgtctcctttcatggtaagcaaagctccgcagaagtttacagagttggggtgtggttcaactttctaaccagccatggttagccacgggtgaccaacccaagcccagacctttgacaagctgcagagtacgttgtttcttaggctgctggagtcacacgaagtggaacttttagtattttaggtgcatgtttatttacttacttatttttgttgttgtcgttttcagatagagtctcactctctctctctgtgtgtggagtgtcgtgatgccatcacggctaactgcagccttgaccttctgggctcaagtgattctccctcctcagcttccctagtagttcggaccacaggtgtgcaccaccatgtccagctttttttttttttaatattttagtttgagaccagcctggccatgttgcccaggctggtctcaaaatcctgagctcaagcaatccccctgccttggccccctcaaagtgctgggattacaggcatgagccaccatgcttggctattaggtgtatgtttaaatccatttgcttatatcagttacataacctgagtgttatgtaaatcttaagcaaaagaaaaatatatgaaataaaaattgaaactcacttcccaactgccaatctcattcctgccttcaaagtttcaggtatttatttctagccttttttctatgctgagttaaactgtgtatcttctttgctttgcatttcttactgagcagtgtgggaaggctaccttttaaaatttatttgtagttctttataatttttacctttctttttaggcagaaagattatcttattatataacagtctacggccattttttcttaaactaaattattgggaaatgaatagaaatccagagtatagtaacaaatgacctagtgtctttaacagattggtagctaggaaaaggaagtgrtggagagacagccggagattaaatgagacttaagagacttagcaaccatttgtaatatgtgaccttatttggatcctattcaaactaatggttaaaaaaattcatgatagctgggcatggtggctcacgcctgtaatcccagtactttgggaggctgaggtgggtggatcacgaggtcaggagatcgagaccatcctggccaacgtggtgaaaccccctttaccaaaaatacaaaaattagctgggcatggcggcatgtgcctgtagtcccagctacttgggaggctgaggcaggaaaatcgcttgaacctgggaggtggaggttgcagtgaaccgagatggcgccactgcactccaggctggcgacagagctagactctgtctcaaacaaacaaacaaacaaataaaaattcatgataaagcagcagctcaaggtgctgtaagaaattcatgatatttataagataattgaaaatttgaacactgaatatttgacattaaggaattatttttttttatatggtatcgatattgtgggtactttgcaagtatcttttaaggatacatagtgattgtggataaaaaatctgaggtctaggatttgtgtcaaaataatacaggaaggggaggtggcgggagtgaaggtgaaacaagaccagctgtgagttgatagttgttgaagctgggtacaggaggtccactgtgcagtgctctctacatctgtgtttgtaattcttttttttttttgagacaaaagtctcactctgtcgcccaagctggagtgcagtggcatgatctcggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagaaccaggaagatctcaaactgaatgaaaaagacagttgatgccaacactgaggtgatagagatgttagaatcctatgacaaaaattttaaagcagccattaaaaaaggcttcagtagccaggcgtggtggctcactttgggaggcttgtaatcccaggactttgggaggccgaggcgggcagatcacctgaggtcaggaattcgataccagcctgaccaaccttatgaaacccagtctctactaaaaatacaaaaaattagccaggtgwggtggtgggcacctgtaatcccagctactcgggaggctgaggcaggagaatcgcttgaaactgggaggtggaggttgcagtgagctgaggtcatgccgttgccctccagcctgggcaagaagagtgagactccatctcaaaaaaaaaaaaaaaggcttcggtaggcagttaagaacaatcatgaaaaaaatgaaaaaattaaaaatctcaacaaagaaatacaatgtcccagcaaaataataataaaaatttaggagataaaaagaaccaaatggacattttagaattggaaattgcagtaactgaaataaaaacttattggataagcgcaatagcagggtggaaggacagagaaaagaatccttcaactggacaacaattggttgttttgttctgaggtggagttttgctcttgtcacccaggctagagtacagtggagtgatcttggcttactgcaacctctgcctcctgggttcaagctattctcctgcctcagcctccctagtagctgggcttacaggtgcccaccaccacttctggctaatttttttatttttagtagagacgtagtttcaccctgttggcctggctggtcttgaactcctgaccttaggtgatccacctcggtaatccaccttaggtgatccaaagtgctgggattacaggtgtgagccactggacccggcctctgtaagcttttttctgtgtttaaaacttttcatttttgtacttttaaaacttttttttttttttaaacacacacattagtctagacttacacagggtcaggatcatcattatcactatcttccacctccaaatcctgtcccactgtcccactggtaggtcgtcaagagcagtaatgtgtggaaccgccgtctcctataataacaatgccttcttataaaaatattttcttataagacttgttttaaaggctccctttaccgtttaccttaccttttaaagaccaaaagaagcgccacctctataaaatagtgatgggggataagggaataaaccttatattctttaacactaaaaacccccgtttgcctttgggccttttttattaaatcaaaagtttttatgtgtgtatttttaaaaacataaaaatacgccggggggcgcgaaaaaaaataaagttataaaagaggggcgggggggtctccctcgttgtgggtatggggtttaaaaacaccccagattttttttgcccnnnnnnnnnnnnnnnnnnnnatttttttatttttagtagagacgtagtttcaccctgttggcctggctggtcttgaactcctgaccttaggtgatccacctcggtaatccaccttaggtgatccaaagtgctgggattacaggtgtgagccactggacccggcctctgtaagcttttttctgtgtttaaaacttttcatttttgtacttttaaaacttttttttttttttaaacacacacattagtctagacttacacagggtcaggatcatcattatcactatcttccacctccaaatcctgtcccactgtcccactggtaggtcgtcaagagcagtaatgtgtggaaccgccgtctcctataataacaatgccttcttctagaatatttcctgaaggacttgcttgaggctgctttacagttaacttaatttttaaatagaagatgcccactctaaaatataatgataaaaagtatagcatattaaatacataaaccagtagcattgtcatttatcatcaagtattatgtattgaacataattgtctgtgctatatatgtttctatggccggtagcccagtgggtttgtttataccagcatcatcacaaatacatgagtaatgcgatgcgttactgtgacgtcagtaggcaacaggaattttttggctctatttataatcttacgggaccatcattgtatgtgtggactatttttgactgaaacttcattatttagcaaatgactatattagcaaataaaattgagctgtatataatgaagaagtatgcattataaccaagtggggtttattgcagggatgcaaggcctcgttcactattagaaaatcagtcaacagcctggctcggtggctcacgcctgtaatcccagcactttgggaggccraggtgggcgatgggcggatcatgaggtcaggagatcaagaccatcctggctaacacggtgaaaccctgtctctactaaaaatacaaaaaattagctgggcgtggtggtgggtgcctgtagtcccagctactcgggaggctgaggcaggagaatggcatgaacccgggaggcagagcttgcagtgagccaagattgtgccaccgcactgtagcctgggcgacagagcgagactccgtctcaaaaaaaaaaaaaaaaagtcaaatagtaaagataccacctctcctcaaattgtcattcaggtttgatgcaattgctgtcaaaatcccagcaagagtttttgcagatagcaagattattattttaaaacctatatgaaaaggcaaaggaattaaagtagcaaaaacaattttgagaaagaagtacaacatggaggaatcagccttcctgatttcaagacttgctgtatagctacagaagtccagattttgtagtattggtcaaaggatagacattatagatcagtgaaacagaattgcagccccacacaaatatgcacaactgattattgacaaaggtgcaaagataagtcattgggggaaaaaaccttttcggcacatggtggcagagaaattgaacatccctaggcaaaacaaaacaaaagcaaaccccaaaccaaaaaacaaaaaacccatataactataaaactttgagaaaaaaacatagaagagaatctttgagatctagagctaggcaaatagttctcagatttgacaccaaaaacatgatccattaaaaaaaaataagttggatttcatcaaaattaaaaactttttaatgttttaagaaggatggtctgtctcaaagactcaacatggtacatggtggttggcctttatgtgctgttgagggttttcctgcattgaagggtgcactcctgggtcacctactgtcctgcaagacaagctgtcttagccctcacactataaaagccacccggacaccgtctcaaacagaactcaaaatgttgctgagactgggatctgggggctggattttacttttacaaacaatttaaaactttttacagttaagaggatgaatatacaggctaaagactgggagaaaaaatttgcaaaccatatgtccaacagaacactagtatctagaacatgtagaaagaactctcaagtcttagtcgttaaaaaacagacaaacatttaaccaaacaacccaataagaaaatgggcaaaagacataaacagtttctgctgaagagaacgtccatatgacaaaaaaacacatcgaaatttgttcagtatcattaaccatgagaaaaatgcgaattaatcctagtacacactatcagaacggctaaaataaaaaatattaatactgataacactaaatgcagaacggatggagagaaactgaatctggatcactcactcatacattgctggtgggaatgtaaaatggtgtagctactttrgaacactgtttggtagtttcttaataaagaaataggctgggcacagtgactcccttctgtaatcccagcactttgggaggctgaggctggaggatcacttgagcccaggagtttgagaccagcctgggcaacatagggagattgcatctctacaaataatttttaaaaattatacaggtgtggtggtatgcacctgtggtcccagctactcaggagattgaggcaggaggattgcctgagcctgggaggtcgaggttgcagtgagccgtaattgtgccactgtgctccagcctgggctacagagtgagacttggtctcaaaacaaaaacaaaaacaaaacctcaaaaaacagtacatgcaactaccatatggcccaacaattgcactccttggcatttatcccagaggaatgaaaacttactgtatatgagagccactgtttttccttctatagtctcacagctaaagaaaaaaaacttttctcatcttctctactactcctctcartatttcgcttccggtcaccaaaatctatggatttctgtcccccatactgacaagttctccaattttatgtggacaacaagtaggtgtcctataatcaattcccttcaattctgacactatctacctgaagttagtgcagacgccattaagggctcrgtccctcaaaactgcccctgacttcagaggccagtcagaagtggtgggtcctcaggyaacccacagcttctgtccaggtttgctacaaatcagaaggtcccattaccccttcctcatgttatgttatttgctagagtggctcacagaactcagggaaacacttacctttagcagttgtgtagtgaaggatatgatagaggatacagatgatgccccagatgaagaggtgcacggggcaaagtttagaggcgttttgaacacaggagcgtctgtccccatgaagttggggtgggccatcctcttggcacatggatgtgttcaccaacccagaagctctctaaactccatacttcagggatgtggaggctaagtcacgtaggcgtgattgacattaactgagactacagttcctctcccttccctgtaggatggggagtggggccgaaagttctaagcttctgatcatgacttggtctttctgttgattagccacatcttgaaagctatccgggagcccactaagagttgcctgattagaacagaagatgctcttgtcaccaaggacattccaaggggtttaggaactctggaaccaggggcagagacctatatatataatttcttactattttatacttatgttcacacacmcacacacacacacacacacccctatgcacagatgtttacagcagctttattggtaagagacaactagaaacaacccagatgttcttcagtgggcgaatggttaaactgtggtacatctataccatggaatattagctactcagcaataaaaaggaaaaaaaccattgacagaagcaacaacctgggtgaacctgtagacaattatatgtagtgaaaaaggccactcctaaaaggttacatagttatgattccattgatgtgacgttaccgaaataataaaattacagtgtggagaacgggttagtggttatcagggctaaggagagtgtgggtgtggttatgcaagggcagcaggagggctccctgtgctaaagggaatgttctctattttgattgtatcaacgtcaataccctggttgtgagattgagtcatagctttttaccgtgttaccactggggaaactattttgagatggagtcatgctctgccgcctaggatgcgatctgggctcactgcaacctccacctccctggttcaagcaattctcctgcctcagcctcccaagtagctgggattacaggcatgtgccaccacgttgtatttttagtagagacagggtttcaccatgttggccaggctggtcttgaacgcctgacttcaggtgatccacctgcctcagcctcccaaagtgctgggattacaggcatgagccaccgctcccagcaagggcattgtttcttacacctacaggtaaaatctgtctcgatgaatttgctcgatcatcttaaaataaaaaggttaattaaaaaaatgattgaatataatttttaaaaatgtcaggcaatacaataaatgctgtttaatgagaaataagcttcgctcctccctgctgtgttgcttccatcaaggcaagctctgctactacttattaaccacattatttccacaattttatatagactcctgactgaggttctctgaatatcaaaattggatattacttcaataacatgggcaaaattaaggctttygacctgcctgattttccttgtcaaggcagtttgtccccatttcccacatgggatctgcagggctgggtcccatctctcagttccctgaaagagatgcagtgggckatggctcatgacacaccctcgcctggcttctaacatgtctgtgtaaacctgtggcaggaatygagcccactggaaacatggtgaagcagccagccaagttcactgtggacaccatcagcgccgggcaaggagacgtgatggtgtttgttgaggacccagaagggaacaaagaggaggtatgttggaggatgctgcctctcctttccagcacctcatggagcttttggggcttgtaatgcggccagggactgtgcctccattttcatttcagctcacaaccaaaagtgttttttaccaaaaggatactgaggcttatagctgttaaagtaacctgcccaagaggtgagccttgaaatcaaatttaaattgattgccagggacacagtgtttaatgaaataaaggatactttggatttagcaaaggtgccttgtcagttgaggtttatgtatgtatttatttatttatttatttatttattgagacagagtttcactcctgttgcccgggttggagtgcagtggcacaatcttggctcacggcaacattcacctactgggttcaggcgattctcctgcctcagcccggctaatttttgtaacccaagtaactgggattacagggacctgccaccacgcctggctaatttttgtatttttagtagagacagggtttcaccacattggccaggctggtcttgaactcctgacctcaggtgatccacctgcctctgcctcccaaactgctgggattacaggtgtgagccaccrtgcccagcctcagttgaggttttatatactgatggccagaataataagagtcttgccctgctctcttsccacattggccattcwttggttcctccctcagagcctttgcacatgctgttctttctgtcacttattttcgtaggaccatattttattcttggcatttagcataatttgcaattctaagtttacagatggatggtccatttcccccacyggggcagggattgtatctgacttgctcatgttttatttttagtacctaacactgggccctgcatttcataagctttcaatgaactattgagtggataaaggtttaagtttcttgcttcatattctctcttacctagagagtgccagcctgacactggacactggagagtcctgactctgttatgcctctgtgctgcatggttttgtttctgtgacttcaagcagtttctctctaggggcgttgtgcaagagggacaggagctcgccagcaccttcagtgtttccgacctggcagctcctgcagaacccctgctgacacagcatgctccttactcacacccggcaccttttctaactgttgcccaccttccctcctaggcacaagtgacccctgacagygacaagaacaagacatactctgtggagtatctgcccaaggtcaccgggctacacaaagtaagatgaagcagcatggctgtggcttgggctgctctggggctaggagaagaaagatagcccaggaagaagagtgtttttcttaagtgaatttctgattttcctttctgattatagaaggatctatgctcatgatagaaaattggaatcactaggattccctctactagctaggatgagttgtttgcaatgtcgtaagatttttccaactccatctaggtaactaatggttgcagctgtgtgtctggagtgtagatgctgtggtgactacactatagatgggttctttgtccttgattctttttttggagacagggtcttgctctgtcacccaagctggagtgcagtggtgtggtctcagctcactgcaacccccgcctcctgggctcaagcgatcctctcacctcagcctcccaagtaggtgggattataggcacccacaaccactcccagctaatttttgcatttttagtagagaccaggtttcaccaggtcacctagactgttcttgaactcctgacctcaaactatcctcctgcctcagcctcccaaagtgctgggattatagacatgagccaccacaccctgctggctctttgtccttaatgctttcttaagaactctccttggaggtgctctggaggagctgtcagcattgaaggctgaggatggagtagttcagctgaatatagtagagggaaatggccctctcagcacctggagaaatgatagggattgaggcctcaggctctttgwcttggcagcctttcgagttctgtttgagatgacatccaggtgacctatagggcaagggctgagagagcctgtcttgcaggagagtggggtgacccaggagtacacttttcattgraagaaagccstcaacagcacataaaggccaatcccatcatgtacctgcccagactttggaatacagactgtactcaccaccttgggctttagtgaattcacctggaatgatggccttagcgttctcttagactcttagactrtgatgcatttggagtaaatgctcttgaagrgagcatttataatgtaattaattaattccagtcaagtataggttcacatgaaacccaacccaattaccccccaaaaatttcagagatgagaacagtgactcaagttttagatggaaatcattctactttgtcccaaatccatgtatctaagaatgattttcgtcccttgaaaaaacagtttggctgtggatttgaaatcctggaactgcatattttattctgagggatagtggcccattcagcccccgaaaggactcaatgtccagagattgaaatgtgtttgtttcctattaaagagactaagtgtatataaggtcagcatttttattttgctaaaggtgtgatgtcccagacccagctgtatggctgaaggggccaggtgggagtcccattcaggctgttaaacttggttccagggctccttattctagacaccttgtgtgtgccatcatgggagrgtaggagaggtgatcatcaatgtatgtggcttgatgtcagtcttgctgggcacagagaagtgattatgtatttctcacctatctgtcacctataggtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggtaacgtgcctctcctccatggatctgacctttgcgctttcttccagaggctgaaatataatcctcggggacttgaaggcctgaccttttgtcttttaaatcaaataaataatcacaaagacaattttttcaaatgtgttatattagatttttcaaaaccagcttttcttctctaaaatactcaggcttcacttgaataagacatacttcttgaattgttggcttcttttccatgtagtaaatagaaaatgcagaagaaggaaacattcaaccataaacccttcaacccctagaaaatagttgttaacatcttggtgtggacctctctgagggcctgtctcctgtttacttgttttgttgttgttgttgggggaacagagaatcactctattgcccagactggagtgcagtggcgtgatcttggctcaacgcaacctccgcctcctgggttcaagcgattctcatacatcagcctctcaagtagctgggattacaggcgtgcgccaccatgcttggctaatttttgtattttttttagtagagacggatttcaccatgttggccaggctggtctcgaaatcctgacctcaagtgatctacccacctcggcctctcgaagtgctgggattacaagcatgagccaccacactggtcctgtttgcattttgcactcagcagcagtgagctttcagagagggtgacttgggctcatggaatgcttgctttcttgtaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaaggtgagtgctgggctgctggccacatgtgcttctcatagggaagctgactgcacagctgggcagggaggccaggaaaacagtcagggcccaacattgaccttatgcctatcccttttctgccagggctacttcagcagtaagtggcttactttgtcctcartatattaatattaatatcttctatgagccacgcagagacctaaatgctttgcttatattaactcatttacttctctccaaaacacatgtacaggagagtmattatcctcatggagggaggtgggactgaggcagtgggaggactcggtagcataactgaagttagcagcagcaacatgggccctgcagcctccattgcttggcctttactggcccaggcacttaccatgactgcatctaatcattgcaccagcctgtgtgttgcaggtgctattattatccctagcttgcaggtggagatgctgaggcttagatagcgttaggtatcagtactacaaggcatcagcagggctagaaccacagactctgttggccttacccttaactactctgctaaactccctctggcgctgggggtacgcatttttctcaaatgttagactctctccctctgactttgttgcccctttttttckgttttgttttgttttgttttgttttccaactgtactaccttttctaacccacacttgcctttccctgttctgtcctctgaatctgcgtctgcagacgtggcttcctcttccgaatcctacctctgggccagcctggaccctgaagctgttggcttcctagttgagaccactgggccagaggcctcttgcttggtaagggctggttgggtgggacttccttgccagttctttgtgctgcttgtgaatgttagctgggcccgtgttctgtgtgattttaggaaactctgtgcaggtgttattattacagcctgtccagccggaacccaaacccactgtctaattgcctttaaacacatctagggcttttttagatggtgaaggagctggtggtgcccttcagactctagccccatttaatgtttatatgaactcagcaattactcttttgatgttgagactgttgcacatgttcataatttccatgagtgtgtgtgtgtttcttaagacacattaaagccctccgaggaagtcctgtcattgtattgtgactgacttctggtatgaccaacttttctccccttgacaaagaaaaaacaggcaaaaaaaattctaacatattcctaagcaaagctcttttttacataagagagcattttgaatagctttcctaattctactattgttttccaacctttcctcactcgtggacttcctttttcttttctggcctgtacatcctatactatttagcatttaatgaataacctttttcttttaatttactaacatcctctctcccacctaaatgattttacatatgtaaaaaaaaaatatatatatatttgcaggggcgcggtgggaaggatacagggtctcactctgtcttttgggctggagtgcagtggtaccatcatggctcacttgtagcctcgacctcccaggctcaaatgatcctcccacttcagcctcttgagtagctaagactgtagatgtgcgccaccatgcctggttacattttttaccctttttttttctttttctttttctttttttttttgttttgttttgttttgagacagagtctcactctctcacccatgctggagtgtggtggtgtgatcttggctcactgcagcttctgcttccctggttcaagtgattcttgcctcagccacctgagtagctgggactacaggtgcacaccaccacgcctggctaagtttttttgtacttttagcagacacagggtttcactatgttggccaggctggtctcgaactcctgatgtcaagtgatccacctgcctcggcctcccaaaatgctgggtttacaggcataagccaccatgcctgacctaatttttcttttttttgtagaggtggggtctcactctgttgtccagactggtcttaaacccctggactcaagcaatctccccgcctcagcctcccaaagtgctgggtttacagatgtaaattattttatgttaaaagaaactttatatcactttcacaatggaaaaccaaagtcacttgccataaagtgccaccgtaagcttatgttcatccataaaccatctaaaatcatctctaactccaagggtatgtgtatgactctttgggaagcagttgtttgccaaatagccagctaaggccattgcaggaaggaggaaccagaggaggaattaccttccgtctgtggagtagagtcccgtcttctggagtctgtgaccttcctgtatagagatttgtcaaattttcagtgttagatttggaaaggaaaagccacttaataacatgacattttccccactagtctcccgtttctatttactgaaaaggttgtccgtgctgggcagaagatttattctagggcataaaggtatcttttatcaacctctagataccatggaacagtagttctgtggacatttcaagtaaggcatattggaagctatcttcgcccttaacttttagacttacaactctaggttttcaagctagacccggaaatgaaatcagcaatggtgtttactgctaattattgcctttatagccacccacattctgaaggccttgtaacagacagcacgaaaagattggtctgcctcagccaaggtggggctgaactggtctctttccaagctgtgttggttgtttttgcctggttgttcaggcggaagacaacaacatttagacacttaaaaatggctgacccaggttttggaacccagacaggcattttcaagtactgcattttccaagaagacttgaaaaagtccagtctatccaattactgagcccttgagtatggcagtgaggtttgaataatgtccagcactcggccttaactccctttcacaaatgaaaggttaaatgctggaagcaggagcacagcatggatttgctgtgctctcctgttttctttgccaaagtcacttttctccagtccttctgtggtgtcactggacaaagttatattgtgtctgtatttgctagcctggtgtgctccctgagtgggacccctggtcttgggcaactactgcatactatttgtgcaaagcaaatattttcttggcgggtggctccaggttaccttggctttcacgactctgactaaagaatgaaagattgaattgatgtcaaaactgtgcttgcagcctgcaatccaaatgcctgccgggccagtggccgaggcctacaacccaaaggcgtccgtatccgggagaccacagatttcaaggttgacaccaaagctgcaggaagtggggagctcggtgtaaccaygaagggtcctagtaagtgttcctttgtttctctatctcaggtgtgrttttggctaactttgcagccatggcatatggatttcatcccacggccagttgtcctcaataatcccagaaggctatgtcaaggatttgaggctatctgggctccttggggaagacggcagtgattgattagtaatgtctgccctggatgcggccagtgggtggcttgacagctttacattacatcaagacttctgggagtagaaaaagcagtgatgtaaaggagttggggaaatgctgctgttggaacaagtggctcattttttattttagacatctgggctcagagaggaaggctcttgcctaaggtcatacagcgtttgtaatcatctgagctggaattcaagcacagtctccaaagccagtgattttcccactacaggttacattttatagagtatgaaattatgtcaagtacttaattactatgatcagtgcttatagaaggagaataaaattccctaagattaagttttctttgtagataaatgccatttgtggaggtacaggttaaaccctgcaacccattctctctccctcttttggggaaggagacagcagatgtggggatgggtgtcttcacttttttcgttggaacagagaagcatttcagcacttctagtctcgggtgtagcagcctttggtggttttactcccatgcctgtggaatcttgagcttcctgtaccaggattgctcttaccttctgtgttcccaacaggctggggcaggagcattctgagctccagaaagttaatatttgacttcacagcaccaggctttgggtcaggctgtgccctgagggtagccgaggttctagactgcccagacctggagtcargctgcttggggactgtcttccctcccagattattccaacaggagccaaggagggtgtgtgtgtgtgtgtgtgtgtgtgtgtgcacgcgcgtgcatgcctctgcgtatgtgtgcgtacgtgtgtgttttctcctgaccttgaatacttgcttgactcaacggctttcctggccaaacctcagggctcaacacaaaacaagttcctgcctgatggctgggtttggagtttgcagcgtcacatctaaaacctgtcctcttgcagatagcgtctgaggactttcttgcttttgttgtccagctttagatggaaaagtatacgctggaacactgaacctaaaactcataccaaatacttctaaaggtttacttcttccccagtttttgtgggggactaggaagggtagctatgattattgggaaatactgaaatgtgactggatttatctttatgcaggcccagggagttcaggacctcagggcccctcgtagccaagcaagatttctaaagccaattagctgggaaatcctccatttcctcataccttgaagcagagatggctgtgtttttagctttgaartaatctcccaggctttgaggggagaggtcccatactctggggcagcccacttggtttttatgtatggtwtatgttttgtcagtgtggctgcctctctgttcttgtccttttgattctcattttgggcctaggattgtgttggaaagattatctccttccttcccacagagggtctggaggagctggtgaagcagaaagactttctggatggggtctacgcattcgagtattaccccagcaccccggggagatacagcattgccatcacatgggggggacaccacattccaaagaggtgaggctcctgctgcagaggggtcttctctggagggtrctcggcccagggcggactcatgggtrgttgcttcccgggctgcaggagggaaagagatctgctttgttgaaaacttttttttttttttttcggagcagcacagacatttggcctgttctcaaaagcagcagaaagttgctgtggttttagctgacttgctttaaatcaaatgctggtggttaggggctggtgggaggcaggggaggcagaaggagcagttagagcaaatgggctgtgtgtctagatgcccgcatataaactgagattctctttttcaatgaactcctttgttcatgaatgccacggggcaraatctgctgtggtttacattaagaccgtctacgtgagtgctgtcaggggccaagggacgcagtctacagctttgccttgtgggcattgcacttgcccctctgcgttctgtgttttccagctcccctggaggtgcaactttaaactccgaataaattcagttagccttgagaaatatttgggcattattgggttccgaatacctaccacgcttttttttttaagcctcccatgccaaggttacagcacattcattcatgtatgagataaagcccattcaaccaagttttctggttatagcataagcaggatatagtgtgtggactctctcactttccagggtcatagtctggggaggcctgcacacaaaggtaaagggccaggaggctggtgcaaagcagcgtggcttgagtgccaacccagtggccacctgagctcccagaagcagtcacattacattatattgttgacatarcagtagctatgggtgagaggcctgcaggaggaagggcttggctgcagtttgggatgccagatgaaaggatcaggcaagtggaaagaatgtgcaaaggaactgcagcttatggctatagtgacaccttactttactcttctttgatgcttcttctattcctttccctrtagcccctttgaagttcaagttggccctgaagcgggtatgcagaaagtccgtgcttggggccctgggctccatggtgggattgtcgggcggtcagcggacttcgtggtagaatccattggctctgaagtggggtctctgggtaagtggacacagctgaccagcatcttctggaggactgaggattacagggcttccgggctgtgtcaggctggatgttggggccttgcctagcctcaatacctttagcttcctggcctcctggccaccctaagccatctctgcgtgctgctgtacatttgcagttgcctctgataccagcattgattcattcaggagaccttgagggcagaaaccttatgtgggtattgtgcctaaaacaatgcttggaacgtagtaaacacttagcaaatagtgttgactgacctttatagtttagatgaatgaatgaatgaattttgctgaaatttggatttggaagataaatatttcctttggagcacagctgaagtatattttaaatacatgtctaatgtatatatgatcattttatatcaggagtcagccagctttttctataaaaggccagatggcaaatattttccacctgtgggccttatggtctctgtcacagttatttgactctgccgttgtagcctgaaagcagctataggaatacgtaaacaaacgtgtgtggccatgttccagtaaaactttatttgcaaaagtaagcaatgggccagatgtggccttcagactrtcgtttagcaacccgttttaggtaatagcaataagcaaaagagaaaaataagaaatcacatttaattttcccttctagagagatgatatgaatcgtcttgtatattcttagtctagagataatattaagtcttttagtgtatccttctagacttttttctctatatatgcatgcaaatattgatttggtacagaaaatatcttrgacaagtctttatatctttatgcgtaaatatagggtatgccttcattttccatagcttccatggaattccattgtatggctctatccatkgtcagsctcttcagttatttccagggttttgctataaaaacagtgctgactgtgtatccttggtaattgccttcagataaaaacccagaagtggatttggtggtgctaagagtgggtgttggttcaaggcttttgccacatgttgccacatctccaacagaagggtttgctggttggacttcccctgttggatgatgataaaatacatataatgtatttaatactatatatatatatatatatatatatcctcctggcctcaagtgatccacctgcctcggccctcccaaagtgctgggatgacaggtgtgagccaccacacccagcccaggcctacatttgaaaaaaaaaawatatatatatattttccaccccttccatctctactgaagacttaatgagcttggttttggaagaaagggatacaaacagatttcaatcttctggccaacacttggcttttagggaggcagcgggaatgagctgtcgtracatagaataggtgctttccaccatataaccagggagacccttccacctccaccccctagggtttgccattgaaggcccctctcaggcaaagattgagtacaacgaccagaatgatggatcgtgtgatgtcaaatactggcccaaggagcctggcgaatatgctgttcacatcatgtgtgaygacgaagacatcaaggacagcccgtacatggccttcatccacccagccaygggaggctacaaccctgatctggtgaatcagctgctgtgcttctgtcttcttgtccctggcccctggttcctcacccccatgcccgaagttgccttaagcagcatgttgagagatggcagagaggaatcatttggattttaggaaggaaacaggcctgcatttgtttgtttgtttgtttgtttgtttgtttgttttgagacagactcttgctctgtcgcccaggctggggtacggtggcatgatcacagctcactggaacctctgcctcctgggttcaagtgattctcgtgccttagcctcccaagtagctggaactacaggcatgtgccaccacagcyggctaatctttgtattgtttagtagagatggggtttcaccatgttggccaggctggtctcgaactcctggcctcaagtgatccacccgcctcggccctcccaaagtgctgggattacaggtgtgagcctccacacccagcccaggcctacatttgaatcctggtagtagcacttagcacttttatagtgttgggcaagtaacttacctatctgactcttggtgtcttcctctataagacaggaatgatagtagtctctgcttctagagagcttctaggatgattcaggaggtggcatgcataaagaccgcctttggcttatgcctggcccatgcagggagctccataagctgttattttcttgcaactccggggatcatatgtcagtcttacagccattttctatagttattatttcaaggtgctccatagataaaggatttttttttcctagttccgtgtctcttaagttggagcaatgtttccaagagtgtcctctcaaacccttagcaggctgataagcatcaagtctgagccagcctggctgacagggagttggccccagaggccacgtgtgctactgttggcccacacgggcagctgtccataggctgatgtcagtctgggctggtagctaccccgttttggccaaatgmtattcctttgccctctagggcaaatgttgtccgtggtaaagattctgagtcccctcaaagtgggaacgttgaaactgggcatgactagaggtctctgccccagttgttagaagttctttaggtcaactcagaataaggcagggagcatgggttagtttgggcatggttttagaacaggggtttccaatattttgccttccctgggccacactggaaggagaagaattgtcttgggccacacataaaatactaatgatagccgatgaacaaaaacaaaaacaaaaaaaaaattgcaaaaaattttataacattttaagaaagtttacaaatttgtgttgggctgcattcaaagccatcctgggccgcatgcgggcttcaggccgtgggttggatttgtttagagagttttctcccttatgagggagagacatttgtttttaagttacaacctactttagcactttacttcccataaccaacctcttatgtggatactgtaaaaccagacacaggtcattttgttcttcccccaccccctggttacctgtctttgtataagggtttagttggggcattacacagaargagacttactatctgcctttgcttcaggttcgagcatacgggccaggtttggagaaatctggatgcattgtcaacaacctggccgagttcactgtggatcctaaggatgctggaaaagctcccttaaagatatttgctcaggtaaatttcagggggccacctgtgcaggtaattgtcaggtaacaagatctgaccacgtaatggcaagttgctgagtccatctgatcttcagtttcctcatctgcaccgtggaaatgataagaagattatcttatagggttatgtgagggttcagtgagactaccatgtagagtactgggckttaaaaaaatcagctttctgatttatattctgtggaaatraggcttgtttgtttcaggttattctataatgtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataactaaaaataaataaatgcatgtcatattttgtcactggttgtcaccgtgttgtgaaaatatggcacattgtagttggtccatgaagttttgttgtataagcaagtggtgacttggctgtcttgggaggccacagtgaccctgtytgatagagacagtgtgagggccacctctggtcctagctctggcttttttgcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtaggttgtgaggcagaatcctggctgttttatggaaatgcctggtcatacaccaggtctgggatccatgcctgacagccaaggcagacatatggaaggaacccatccctggtgggccttgaatgatggaggggcccgaagggcagagtgctccagcctgctcagaagaactatttctaacaatgttttttaatagtattttactgggtccargtggaggagaacttgatgaccttctccatgtcttctctaggtcaacatcgggcaaggtagccatcctcagaaggtcaaagtgtttgggccaggtgtggagagaagtggtctgaaggcaaatgaacctacacacttcacggtggactgtactgaggctggggaaggtgagaaagggctttgttcaacccagtgatcattgctccktggggaaggcagttcttttcataacgtttcaatkccttttgaactaggaagtagtccatctgaataggtaatcatctactgagcctctgagtcattccttagtgatatctttgctaatccatcatccctttccccaaatccttactctttctcaggtttcttactagaaacttcccaattgctttttgagggtgttaacctgagctggaagagattgcacaggacatgctgtttcttgtaagctggtgctaataagctggtctgttccaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggtacgtggtggggcctgggaggagatgggtggagtaggcctggattckctttggccacttgtgtgcatgtctcatctactttttggtgttttgttagtattattatttttgagatggagtctcactctttcacccaagctagagtgcagtggtgtgatcttggctcactgcaacctctgcctcccaggttcaagtgatcctcccacctcagcctcccaagtagctggggactacaggctcataccaccacccagctaatttttttttaatttgtttttatttttttatttttttttttgagatggagttttgctcttgttgcccaagctggagtgcaatggcatgatcttggctcactgcaacctctgcctcccgggttcaagtgattctcctgcctcagcctcccaagtagctgggattacaggccaccacgcctggctaatttttttgtatttttatagaaatggggtttcaccatgttagccaggctggtctcaaacttctgacctcagatgatacgcctgccttggcctcccaaagtgctgggattctaggtgtgagccaccgtgcctggccactcagctaattgttttgcatttttagtagagacggttgcccagactgctcycgagctcctgacctcaggcccacctggcctcccaaagtgttgggattataggcatgagccaccacatttggcctcctttttggtgttttactgacagggaagttgtcttgagaacactgctcaatcgttttctctctggctccttacaaccaagaaggaaaaaaaatttacccagagctaaattattaccactttctaacaaaagtgaggcagtgtgttcagtggttaaaagcaggggtctggagagagactagtttgtaataaattttcatcaatattttggttgaaatgcagttagcttctagatatgttctactttgatgcctttgaagcaatgactgtggtctccacccttaaatttttatagagagaggtgatttgaagtttcaggtatgcaatagtgaagatagggtgagcaggatcctgaaagagagaattttgaaatcctagggattaaaattaaccttacataaaaatggaaatcttagtagaatgttctgtgcctaaaggtagtggtcttgacatccatttaacctcttctgcctttattccaatagtctgcaacattctttttgaagaattataatcattctgtctctgatcacttcttgcatttccccagaccttagctctcagctgtccctggaggacatttccttcccccagccccatgtattattgtcgtttttggttttattcttgttggcatttttcatcctgagtactcaacattcagtattaaaggctcaaagtcctcgggtttgtttgtgacatcagggatccaggcattagagagtgacctgttatagaaggccctttcccaatgctgggcycttttggcttatcttacccttctgtttacctgtggtaayagaagtctgctcaccactcgctaagtcagagtgatgctaaggttcaccctttgttgaaggctccctgagctctggctgttgcttcaggggctttcctactaagactgtgtctctgctacaggaaatccccrccagccctttcagagtcaaagttgacccttcccacgatgccagcaaagtgaaggcagaaggcccagggctcagcaaagcaggtaagatggcacgtctaggttgtcctgggcccctctgccagccggtggcactgggcgtgtttcatccacggccttgaggaacttcatctccaccaacaccaacaccaagctggcaggttttctgtgcagctctgatgcagcagtggctggccaggcccgttgctggctgtcataatagacctggtgctgttgaacctgtctgacgggttctcaaagtgaaactactccagctggtctgtctcctcacttcacagtatatctttccaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacaggtagggtccttctcccctctgctcccctggcccccagccaggcccctttctatgcagtcggtgctgggtcactgtggacaccaaggggtgtgagaggtgctctgccaaagtgctccctgatgggaggcagctcctggcactttgaacccctctgggagcacctataggaagcccaatgggttctatcaggtgaactgcagaattccccaaaagcaagcaggaagctggtcccatatctccacctttggtttgcattttatcagagaaatgctcagttcttgatattcaggccctaatatctatctttctgttacacatgtgcacacatgtgcacacacacacacatacacacacacacgtgcattccctcgcggcctcaccagctgccttttagtcttttcattaattacccacagaaaaagagctgctacacctttgtgtttccttcctggtccttttagcttagtttaccctttttatgaggtgttggaatgaggtcttttctcaaagagccagttcagcctttcgtccctaaggcccagcacactatttagggcagcaaattattcccctttacaaaatgcaggatttcacatgtgatcttaccatctaggctggcttactctgattatttcaggccataagggccttaaaactgcctctctgtacaagttaatgtttatttgtttaaaaacattaaaaaaaatttgtatcgtggtaaaatacacataacacaaaatttaccgtcttaaccatttttaagtgtatagttcattagtgttaagtgcattcattatgtcgtgcacccatcaccaccatccatctccataattctttacatcttgtaaaactgaagccctgtatccattatatttgtttaaaattttgtttcgcttcatgttcacacctctggggtctggagagcagacatcctggcagaaaagtctggattttaatacttaagcctagtgttcgaagtggttgttccaagcctctgagattcctttattcttaagggaaatgatcctgctgtgtttgaaatgccatttgtaggagaagaagggcaacgctttctgcagaagcactgctcagaagccttgctcccgtctgggtcctctcagcgaggagcagtcaagagtcaagtggggaagaaagaggattatagtgaggaaggggtcatggtgtaactgtcccctgagtttgggggctgcactcccttggagatggaatccttactgtgagaacatccctgcagtgggagggattccctgggcgaagggattctgtgtgtcgtgttataaatgtggccccttacatccaggcttgctgctgtttgtgctttcttccccaaatttttatttttatttatttattttttagacaaaagtcttgctctgttgcccaagctggagtgcagtggcatgatctcagctcactgcaacctctgcctcccaggttcaagcgattctcctgcctcagcctcccgagcaggtgggattacaggcacatgccaccacacctggctaatttttgtatttttggtagagacggggtttcgccatgttggccaggctggtctccaactcctgggctgaggcaatcctttcacctcagcctccaaacctgcggatattacaggcatgagccactgcgcctgacctcagtatttgtctttttgtgactgatttatttttcttcctatatgtcctccatgttgtagcacgtgtcagaacttcattccttttcgaggctgcattccactgtatgtatatatgttttgcttctctcttcgtctgttttttgtttgttttttcttgagactcgctctgttcctcaagctggagtggcactgtctcggctcactgcaacctctgtctcctgggttcaagtgattgtcctgcctcagcctaccgagtagctggaagtacaggcacgtgccaccatgcccagctaatttttgtatttttagtatagatgtttcaccatgttggccaaggtttcaccatggggtttcaccatgttggccaggccggtcttgaattcctgatctcaggtgatctgcccacctcagcctccgaaagtgctgggattataggcatgagccaccgcgcccggccatcttcatttgttgaagaacatttgggttgcttccgtcttttgtctgttgtgaataatgctgggtgtacaaatatctctttgagtctctgcatttaattcttgtgattatamacccgaaatggaattgctggatcatatggaaatctctttttaattttttgagaaactactatactgtattccacagtggctgcactactttacagtcctgccaacagcatgcaagggtcctggtttctccacatccttgctracatttgtttttttttctgtttttttttttttttgttgttgttgttgttgatagtgaccatcctgttgagtgtaagatggtgtcttattgtggttttgatttgcattttcctaatgattagtgatgctgatcatcttttcatgtgcttattggtcctttgcatattttctttggagaattatctacttgcccatttttatatcaaccttcttaattttatgttgagttttaggaattctccatgtattctggatattagttccttatcagataaatgatttgcaaatatattctctcactccttggtttgccttttcacgccgttaacagttctcgtgtgcaggttataaacgcggcttcttatctccagacttgctcttcctgtgctttaaaataaaaaatccaaaacaaaacattcattattagtaatgataaaactaacacttttatagatagagcattcttttctcatcaggccactcaatagtaagtaggtaattattttcctgctgatggttctgagggttggtgggagccttactactgggtgcaccacgctgaatcttctttgttgccaaattctccatattctttaggagaaagcaccagaaagccatagctgtctgcgtacaatgactgggatcacaaggccatgacgtcttctaaaaacattttgtgacttctgctttattctatgtctatatgccttttagtgttttggctgagccgttagaaagtaagttgcagatatcaggacagggtcagggtttgacctgcatccttggaaaggactgcagaacccagtaccccagacgtcccctgctgctggttgaggcagaagtggagattaggagcctaggtccggttttgtcccctttgaagtaatgctggagtgggaggctccttacttcagagtcaccccaaggtcacattcatccagttctctgatagcagcaggtttgagaactgctgccatgctgagtactcacttagggctttgtgtccggatgctcccaggatgcattcaaggagccgggtgggccttggtggcggtcgttgccaccaagtggcaacatccaagctgcttgaagccacccacaaccccacaaccaagagaagagaagaccaaagtcctcaggtaaatcacaagtgtgaatgacttgcagggtggcactggggtccttcttgttgtttgttgcttggagctgggtttattgtttcattatttgggcaacttgcaattctgcctatttttctatggcaaagaacacattaaatctctccttagattgaatttccttcccacccccacccccagcacagagcctggccctataagtgctctgtgtggattaatggctgtgagtgagcgaataaatgacatggtgcctggattcacaagcggagatggcctaagaacgttgtaatctggtagaggagtgatgccaacacctcctcattctcctttgaactctgttttctgaagagcagctaaaagctcaagactgggctaaggaagtgtgcccttggatgtggttaagagacctgggtcagcccagaaagccaccccctgacacgggggagggagcatactttgagggctgacacccacaggcacaccttctcatggtagttttagggtataacaggctggaaatccccagaaaggtggctgcttgggcatgggtgtgtcctggcctggtgtgggcgcttccccctcagaacacaggctgtgccacgtggggagccgaggtcctgcctgagtaacccaggtccctgattgctggttttgctccctgacacctgcaggcctgccactccacctckcaaagtccctgagtgacagcttgcaggtgcttgcctgcctggggtggatgagtgatgtggatggctgtaggatcctgtgagtcccttgaggatgcaaaagtagagcgcgttttgccttagaggaatggacttgttggcttggggcttgaggaccctcccagaggtcaaagactcggttttatagaagggaagtgatttccctgaggactttggtcttctcttctcttggttgtgggtggcttcaagcagcttaaatttctcaccgcacgttcccctgcgcagagcagtttgagaagctggtggcaatgtctccattacgtgctgtgctgggagccactaggattggggaccactccatgtagtactctggcacctttagaaatccctgtgagctcacagaccctcacagagtaacagcttctaccttgaaatgttcttaacgtggtggtcctggctgctcctggagggccctaaaagggatggtgctgagggtggctctctcagtcccatcctcttctgagctgtctggtcagtgtcttgtgtatgtatattttgaagaataagattcaggtttcagaagcatgtagaggagagtgaaactgtcttgcagcctgcgaagtcgtggcgaaatgcactggccatcactacccagacatccctcacttcatagccctgttggggaataaacacagtccattccttagttggggcctcaggggacactttaaaatgctgtaggcattgtaggtgtaaatctccgagattttttccctcccccttcttaggttatttaaggtacagttcattttctatctgagtttttgttttgtttttgactggtaacaagagcatactttcttttatgggatgggtgggcttaactggaagagggtttttccctctcttttttagcacttcagagaagaggccagaaaactttatgcgggtgagggaggaggtatccccaagacctctggttagcctgaggtctgcttagtgagcccctgaattgttaggggctgtggggaaacggaagctcgggaagagttggcacgttgggaatgccacgttggctgaagtagcgagtcagtcctgccttaaacagtacaaaaaggagacctttcctgccccttggctggctcccagctctgttgaatttgacctgtacacattttaccaggaaatgttgttcacatgaggcagggggccaattggttttgtgtgcagtgcttaaaaatgctggaaaattaatcctctcttcattgatgcaaccagtttttttttttttttcttggcctttacccccttccttattacaaaaggaatgtgacaaaatatacataggccaaatgctacacccttttaacacttgatcagcaacagctttcagcagggcctgcaytccagcaaggctgctggattcttggggggaactcgtctctccctcacactttcctgttacattatgcctggccgattgtggtgaaggsgatcttgatctactgagacagccatgagatttcttggagcctcgatttggagggagggaacttggccaaccatggagagaagaagccggctgtgtgccagcctggaaccggcgagaggagagaaatggcgcacacatggctatcgcgtgccacccggccacccgtgagggtgcctgccaatcctgcaagcaccatctgccttcacacttgcaattttattttctttcacatggaaatggaagttcagatattgtgcgatggtcttagcacaggtctaggtgaactcttgcaaatccctgttgcagcctgggggcctcaaactgattcctaggacagaaatggttctgtttggtgagtggccccaggcccagctgcactggctggcactgggtatgatgatggggaggtggtgtggcagagcagctaggacacagatttgggggccatgggtatgaggcccagctcgcacccttaccaaggtgtgtgacttggggcacgttcctttaccagtctgagccacagtttcctctcctgaaaaaatgagatgacagtaggaactaccccttaggactgttttgatcttgaattgaggaaatgcataaaagcacatagcatggtgcttggtgtgtagaaaatgctcattaagttgcttctgttattattagctgctcttatttgatctaatttttctgttattcttgccttgtggtcaaaagctagaagaaatagatctaagatactttctacattgattggaatcaagtctcccctgtccgtgagaagaatgagggatcttgaggggattttaaatgccaagttagctttttggtacccaaaggtaaactgagttttctctcttgttccagggcaacatgcaggttctggtgacttacggtggcgatcccatccctaaaagccctttcactgtgggtgttgctgcaccgctggatctgagcaagataaaactcaatgggctggaaaacagtaagtgcctgaatggagagcagatgggttgttgatgaccccccaacgtggctgctggttagattttcttcaaaaggtgaaatttgcagagaagcaaattctatgttaagagactttgcagttgcacagactttggttcgaattaaggccgtggtgtgaartaactgtgactgtgtctgccccttagccacaccgagactcagctttctcatttgtacagtggggggtggtcggcggggagaggttgagaacacccatgggaatattttgaaaattatatgagctaatggttcagaggctggcacgtagtcagccccctggcattgcagtaggaagttttcattaaaaagagaatttgggctatgttgctttctgatgagtttctaactgtgccagctatccttggcaactgaatccgcactaaggttgcgagtcaagcataaatgccaaatccctggcactcagaagtcactaccaccacacctctgccccatcccaatgttcctttagcttgttagggattttactagtataagctcatttcgcttattttcaattttctgattattttttagtagggaaaatttcaaacagaaaaggaaagagaatagtataacatgaacactgatgtacttatcactcagcttcagatgtgcaacacatgctcataaaatgatttttttatacaagtaaaaatatatccatttttcatctaaaaaacattacagttaagggataattccactttaaccctcacctctccttctccctagggttaaccaaagttttcaattcagtttctgttcttccagatcttctctctgcatctatacatatagatgtgcctgtggaacacatttggctgtatttattttgcattaaagttgccctgctgtataaacctacttcttcggcctgccttccaacagtgcatctcgggaatcattcactcctacatcttttccgtctgtgtttactgctgagtggctccagactggatgtacctcagggctcacattcacctggtttcaggcttactgaggcagggctgagtgcatatccccaggacggggcctcctgtattcacctgtgagggtttctccagagtaccactagcagtgccattagtgagcatcttccttcactcgtgacccaagtgcacaagttgcaagcaaggccagctcccagttgcagagatccaaagtgagagctcactgttggcttttgtggctggagcagccagctctgagtgtgtaaacgtccactgcccaaccctgtmatgtgtccccttgtcactcctttccccaagacactgagagctttgactccagaacaggaaaagcagggtgccaattaggaaagcctcttttccggtgggaagtagcgatccgggacctccttgcctgtggttcggcagtgtccatcttgccaggccctatgttccttcagagtcaaggttctctgggttgtggcaggggccctgtgttcccagtgcttttgttttgggtaaagtcctttccctgttcttgtctaatctaacacttgggcttcctgcagccctgctttgcagagaccttttggaaaccatcacggtacagtcagttctcagcacttgcttcaatcggctcgcatttggcagctctgtgacttctgctttcttgagggggaggggtgcctataagatggagttggctgccaagaattagtaaataaaacattgacttatgagggtgtttggatatcaagttaacaccaaaagtaagtaaataagagacgacagtgtcagattacaactttctggtcagcaaagattgtggggtcaggtaaatttcactttgagtcccagcttggcaggctgctgcatatgtcaccctggacaagttacttaacctctctgagcatcagtttccccatctgtgaaagccattggttaataataaataccccataggattgtggtgaaaattaagacaataacctatttgtgcttggcatataaaatgcattcagtaaatgatagccgttattgctgtcatcactaattgattattgtgccgacacttgttgttactgaggctgagatgctgatgatacttactcagctttgctgcttgtcctctgcagcagctgttgcttacagtggaggctgagataagtccccgtgtccaaagaaccattgcttctgtgctctggattgttcctgctgctgaaaagggtcagctcttcacctcagcttgtgtttcttttccaggggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacrtgacctacgatggacaccctgtgcccgggagcccctacacagtggaggcctcgctgccaccagatcccagcaaggtcagcctttgcttttgtcccagaacttgtctcattgctgtcaaacatgacaccatagtccttctctggttcttcctggcaaagaccttctgaaaatcgttttgtgatgaaagttagcacaattcactgtgaaaggtcccctgggtaggtgggtcacaaccctgctcctcctcttgctctctgactacaagactttggtgaggggctccctgtcccagagtcttctttcttcgcttgttagcataatcacagtcctcactacaaagccagcctgtaaggggtaggtgagttagcaaacgtggaggcctctgcccagcacccagctcacagacggagctcaccctccagaagctagaatcatgtaatataaaaatacattattctggccaggcgcggtggctcatgcctgtaatcccagcactttgggaggccgaggcgggcggatcatgaggtcaggagatcaagaccatcctggctaccacggtgaaaccccgtctccactaaaaatacaaaaaattagctgggcatggtggcgggcacctgtagtcccagctactcgggaggctgaggcaggagaatggtgtgaacctgggaggcggagcttgcagtgagctgagatcacaccactgcactccagcctgggcgacagagcaagactccgtctcaaaaaaaaaaaaaaaaaaaccacaaaaaaaaacattattcttggctgggcgcagcggctcacgcctgtaatcactgcactttgggaggccaaggtggatggatmacttgaggtcaggagtttgagaccaacctggccaacatggtgaaaccccatctctactaaaaatacaaagattagctgggtgtggtgacgcatgcctgtaatcccagctactcgggaggctgaggtgggataatcgcttgaacctgggaggcagaggttgcagtgagctgagattgtgccactgcactccagcctgggcaacagagtgagattccgtcccctccaaaaaaaaaaaaaaaagttcatcgtcatttcttcatagtaaccctgactcaaggggttttggaagatttccagtggtctcaatggtgtgaatcctatgaaggtgtcttatttgttgaattagaggtgaaagcctccttcctcactcttttttagaaacagtttagttttattattatgcagaatttgttgagcaaattgcaacagcccaagccacagctagctccacaagagcccttccatgagccctcaacctgggatctcgtgtatctttgttggaatggacattaggtttccaagtccaggcctgtgatttagaagkgtcaggtygggtaggagagaggagagtcttggaggggctgctccatgggggtcacacctctctcctgtgggttttcgctggtgattgagttctgaggcatttgctgcattgactgttgtagctttaactcgtgtgcacgtgtgacacataaagccccaagagaagggctgcctggctcagatgcacttccatgctgattatatgcatgggtgttgaaagcagtgctggctgagcagcgatcccagtgcagtttgactttattctttgctcaaataggtgaaggcccacggtcccggcctcgaaggtggtctcrtgggcmagcctgccgagttcaccatcgataccaaaggagctggtactggaggtctgggcttaacggtggaaggtccrtgcgaggccaaaatcgagtgctcygacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcractgctcggaagcgggaccgggggccctgggcctggaagctgtctcggactcrggaacaaaagccraagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaaggtgggtttcatttaaaaaaaaaaaaaaaaaaaaaaagacaagctgggacttaagggctacctgaaacttggagctgcaaactcagccacctgcaggagccaggtgacatataaggcggtgctcacctgttccctctgcctcggggagtagttggggggccctggtgaaggttaagcacattgcatttctggggaccgtgctactcaacccctgttttctgtttctccatggggaacaggacctagcattgtcagcagaatctctagttttttggcaaaggcagaaatcttgatttttctctggaaactcaacatacaacatgttggcattwaattggaaaaaagtttaaaatgtrgtgttgtctaacacctgcatgccacacagcaggttagtcttcaacctttaacctgtcctcgagcccggtgtgagcagtcgtgttgtcacttagcygtggctactctagaaaggccttctttgggatggagggggttaatattcttgatttgagagttagaaaaaccagttttccagttactgaaattggacttcatgtgtcctgaagtgccaagaaccttggttctggggtttgcttttgggtctggggtactggtggcagtgttagctatgtgcttgctctgcagatgtgttccgggaagctaccaccgactttacagttgactctcggccgctgacccaggttgggggtgaccacatcaaggcccacattgccaacccctcaggggcctccaccgagtgctttgtcacagacaatgyggatgggacctaccaggtggaatacacaccctttgagaaaggtgagccgccctgtcctcggactggacsctcgttcagagctgcccttggtcattgcctcctggtggctggtactgatgcctgccccatgtgctaggcctgtctcagcagggccacgtgcagagtgacagagtggaagtcagcgtccgctgcagtcacctgcccactcagtgcctggcttgctggccttgtgtaataggtgggctgggtttagcctcagtctcacctcagcaagttatggggtaatgtcatgatgttgctcatttgtgccatttttctttgcgtatgaatttctttcttcttgagtattaggaattataaaaaatttcaataaatagaaaaccataaagaaaaaaaagtgccatgtatatctccactacctggagatcggaagcctgcgatattctgatatagatattttcagtcttcttgtggatgcctgtttcttctgtttcacgggtttcrctttttcttttggttaatggctggatggtgttttcccgaatgagagtagtctgtttaggatgactgacttgaatatttgcttggttggggtggagtggcttatgtgactgcagatagacggtttgtattatttaaaagtcagatcatacctacattactgtgggattgttttgttttgttttgaaacaggatgtcactctgttgcccaggctggagtgcagtggtgtgatcacggctcactgcaggctcaacctcctgggctcaaatgatcctcctgcctcagccccctgagtagctggaactgcaggtgtgcaccaccacactcagctaatttttgtattttttgtagagatggggtctcgccatgttgcccaggctggtcttgaactcctggactcaagtgatctacccacctcggcctcccaaagtgctgggattataggtgtaagccactgcccccagccacattactgtgtttttaacccccttttccaaataacatagtatagcatgcagacttcgatgctagatgaaactctgaagtagagaatcatttttcacaaataggggatttgtatgcaaatatgcrkttctgtttgttgttttgagcaggtctccatgtagtggaggtgacatatgatgacgtgcctatcccaaacagtcccttcaaggtggctgtcactgaaggctgccagccatctagggtgcaagcccaaggacckggattgaaagaggcctttaccaacaagcccaatgtcttcaccgtggttaccaggtaggcaaggccctacatttggtgtcttgagtctcacttttgtggctagattctacctatgtgtcatggtttcctaacttttgataagatgaatttttatttttataacatgtatttccttctgtagagacttatgttacatagaaagaccaagcatacctaaaaaacataccaaagcacttgataatggtcatgaaactatttagcaaaccaggagtcaatcaagctctataacttgataatgtaaaaatttgtagccaaccttgtaagtatttttattaaagttggttrcaaggcatatgcctgcgttgtacttgcagtcctagccagtgcaattagataagaaaaataggctgggtgtggyggctcacacctgtaatctcagcacttcaggtggccgagacgggacaattgcttgaggccaggagtttgagaccagcctggccaacatggcaaaaccccatccctacaagaaatataaaaattagctgggcttggtagtacacgcctgtaatcccagctactacttgggaggctgaggcatgtgaattgcttgaacccaagagacataggttgcagtgagccgagaccgcgccactgcactccagcctgggcaatggagtgagactctgtctcaggaaaaagaaaaataaatgaagcataagcattgaaaatgaggggtcagagtgtctttacttacattatactaatgtgaaattccctatgtgagaggtgtagtaattgagttggggtggctacgtggaatagtttataaaggrartttgcatgaattttggcaataagcagaccagcataaataaatggtgcacatttcactttcttttccactcttkccagaggcgcaggaattggtgggcttggcataactgttgagggaccatcagagtcgaagataaattgcagagacaacaaggatggcagctgcagtgctgagtacattcctttcgcrccgggggattacgatgttaatatcacatatggaggagcccacatcccyggtgagctattcctcagagaggaccccagagaataattgattttgcaggaaaatgggtttgattttgsttatctctctgagtggggaaaacaatctgatatttgtaatagctgcaaaaggagagtttttcttagggctacatctccaagattatctcaactcccagtagaaccggtaacatggcaaaaagcatcggcttagaattttgactggaaacagttgtgcgtgtgttggaggacctagttcttgattcaggggaaagctggttctttacaaagttgaaaatcacagtggctcacacctgtaatccccaaactttgggaggccaaggcatgcagattgcttcaggtcaggagtttgagaccagcccaggcaacatggggaatccccatctttacaagaaatacaaaacttagctgagtgtgatggtgcgtgcctgtaatcctagctatgtggggtgggggctgtgatgggacgatgtctgagatgggagcctgggaggttgagtgagctgagattgcgccactgcrctccagcttgggtgacagaggaagaccctgtctcaaaaaaaaaagaaaagaaaaagaaagaaaatttctaccttattttgtgcttggctccttattcatgtgtcttggtttcttttttttcactgacaatactagtagctgatcaagatatgcagattcaaattctttcttttgtatttagtgatgtcatgtgtaatcactgtgaaacacggtttctcaactccggcactatgacactttgggctagatgattctttgtggtgtggggctgtcctgttcattgtagacttttgtcagcatccctgccctgtacctgctagatgcccatagcagacttctccttccccattcttatttgtggcaaccaaaaatgtctccatatcttgccagatgtcttaagggacaaaatcacttcagcctgaaccactgctgtaaagattcaaacaataaataaatatatgacttaagtagtgaaagaccctcctccatttgttttggsgggaggactctccataggttctagttatctactcaaatgattgtcacccccacacattttatttatttatttcaatagctttggggtacaagtcgtttgtggttacatggatgaattctayagtggtgaattctgagaccacctcccccgcccccatttctaaaagggcaggcaagtgtgtggtgtggacagaagaccgagggctggggctgttctgggccacttatgccttgtcttaggtgtggtgtgaagagggcaaagccccaccccaggaccccaggagcagaaagagcctcagcggggtcttgttcttctttctctgggtcacgctgagaggggaagggcaggttgaggggcccactgctgggttctgggttaactctcaggcagctggagtgtccactgaccacacrctttcctgattccattcctgcttcccccttaccacatggaaatgtgcacacacactcacactcactctctctcacactgatcagaaagtattgacattcaactcagactgattctactcagatactcatttaagcctcaagtcatttaaaacaacatgtttctcctcaaacttgtgcttgcggctcattcaatatagatttaaaaaattcctataatcactagtctaggggacttcagctgtgggcaagacaaagttcctgccctcagggagcttactgtctagggcttttacaactaaaacttgtgatgactgctatgaagaatgagaatggggctcggtgacagaattcagagctacgggcttgttttggagttttgtaacacttgcgttaggagagagttgggcacaggaaacgggtagaaggctgctcccaggaggggtgatgtggctccgacctggcaggcaacagtggagatgaacatctcctgtggcaatgaaactttttgactatggggaaaggctggtgagtgccaccagcttccgaatcccccttacagaaaggggtcagagtttgtcccctgtggccgacctgtgagcttaaagcaaatggtcgtctttgagcataacaacagaaagacactcatttgtggttttcccatcaggtgtggatggtgcctttttatgtttcaggctctctgttgcctcccagagagccaaatgccrgcttttccagaaccccagaactttcccaggcagagatatttagtgaagtgttggttggttttctaagcatcaggcttcttagctaaggcaacctatgggggtactgccgggaaacagtcggctacctgccaccttctaatttgctttcatggtaattctgggtgcttaaatattagcctagtttttcctggcctggttaaaaacccggagtggagttatttttaacaaygtgtcctgtcttacccgtaatggcatgttgatttcctgtggtaggccagctgtggttggttggtggcggctccctagaccactggattgactggggttcagagtgcatgaggaagaagatctggcatgagggaatggtgacatgtgtctgggcatggaacaggggagtggcggataatgcttggggtctgccatcttggacagtttatcttacccgggtttgttggtttttggctactctcatgctgagctcasacaacttctagtggaggctctgacttaaagattggcctcagaggtagtcccttgccatcagctgttgacattgaaatcctcaactgtcactctctaaagtaaagcccccttttgttcctctcaccccagtgtggaggcctgtgcttgtttgccagggccagccatttatttcacgtagctaaagacctggatgccgttgaaacccagctgttgttagaaagccagggactcaattctttgtgtgtcttggctgtctaccatctctaattctacaaagtataaattctctgggatgcaaagcagagatccctcagctttcacggcagtcattaactttgccagataccatggggagcaccaggactcccatgcgaggcagaggtgcacgtagccccttggtgatgggcgtggtagcctgaggcatgctgccgttcgctggatggggaggtccccctccacagtggagtccatgagygtccttggcctagcccttgtttctctgtttagcacttctctagcaaatcactatctcctctcctcgactcctctgtgcttcatctttaaaactgacaccctcaaggagtcagaggccctcagggtcccccggggggtcagccatgtagcaggagctcagcttacactcaggaagacggcaaggcttcaccaggtggccgagtgaccgagaaggctgagtgtggtcagaaggtgccagctgcattggagggagaggagtctgggggacacacaggagccatgtgtgggggacagggctggatgtgggctgcagggcctgcccatctctctccgttctgttgttccaccacttggcttcctccttcagttgctccagcagcctgtctcctccctcgcctctaggctcctgcatgtgctgaggcctctctacttgaagcacctctctgtctgctccctcttgtgccgcaactgagatgttactggaaagctttctctggtctcccgcagaccaggttaattgcctcctgagtgctccaccttccacaccccaaatatgttatgtaggatgttagagtgacttgcttgcctcatccttctcctgcagttgtgggttcctggggggtgttaaccgctcaggatccagcacgtggcacaacatctgcacgtagtaggtgttctgtgagaatggttgacaacaatgagtrggcacatgagcagtgcacacagtgaggcagggggagctgacygaggcctgcayggccgaggtcccgggggagcagcagtgctattctgggtgtgcacaaggtgktctccaattcccagcttgtgctcagaatcccacaacctctcttccaggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggtaagtgtgcaccctgccttcctgcagacattcatctgccccaggcaggggcagctgtaacccagagcagatgctttgcttttgagtttgctcatgagcttaaaattaaattaaaaaaaattattgtttcatttctagttaaacagtagaaattcctgcttacaagtaagcaggcttgttatttctccagtgatctgtccccccatttaataatatggctatcaatttcttagaggaagcagcagtatttgggctgtcatatgtaatatggtggcgactgtttcattatgtgtttcagcatttgtgagggggtgggttgstctggatgtggcagatggtggggtttggaggtgataactcattgagatatcttggtgtccatgtggtacataccagaacctctgggaatgccaggcacatgatgcacgtgatacgtggctttgtcattgtcttagttccccagagagagagtgtgtcttggggaatgggctttgttggcaatttggcctgccttgttggcagcttggaacttgggtttggtaaggctagcgggccatatagggacaaagccctgaagtgcattggaacttgccttttttgataagtgaccrtgtttcctcctccagcacttaaaatgtgcctttctcccacatagaggacagtgtgcctaatttcttacgtaatctgsattttcctcgccaatgatatgttcttggattcacagaagtggcaaatggggktttccctctttgaagaggaaccttctccttcatggggttcagcaggaggttttatcttttgaagctcagggcagaaatggtttgggggaaattaggtcatgggtctgggatcagattctgtgaagttactgagcttcaggacctgcatgtgtttgtgtgcatgtatgtgtccctgtgtatgtgtgaatgagagagggagaaaaagaagaaagagaagctttacttggatatctgcctctattatgaaggactctcaagtaacagccttttgattttagctgacgacacggattcccagtcatggcgcagccccttgaaagccctttcagagttctttaaaggtgacccgaagggtgactttaataagacaggtttgcattttcccatggctgctgaattatgtaacccaaatgcttcttgctggcctcacttctaaaattgcttacacctgcctcatctgctttgcttaatgagcatgccatcctttgattaacctaccctggagttgacccatccttgactgtcacgttggaagctgggatctggactctgcaacccaacgcgtgccttgattatgttttagcataatctctaacatctccacaggcttcaccttgagggtccccttgccccatgagattggcaccctcacctgccctgcacctatgccccagcatgctggtaccacagtgttctttgctcaaaggtggccacaagtcttgactagccagcccattggttaatttttgctcttcacaattctggactctttggcartgtctcagctgtagagtaaaattgccacatcctaagcgtgcctaaccagcttgaaaggttatattgtgtcttcaacacacatcatccacatacaccctccagcagcaagcacaggcagtctccttaattatactctagggcagactgagtgtattttagccaacaaaaagctaaaggtgtctctcggggtcatttctgcaaccatgaattggggatcctgtgatttttttcaggcctgtgattatggttgctggcctttttgttactcatcagtggaaaccaatagctcttggggatggatgtggtcctatttcagactcagccaagggtggagtaaaggtgaggccaggcagctccttaaacctctcatctctgtcctcaggcttggtggagccagtgaacgtggtggacaatggagatggcacacacacagtaacctacaccccatctcaggagggaccttacatggtctcagttaaatatgctgatgaagagattcctcgcaggtaagctccatccatctgcccatccattcctccatcagtctatctgtccacccatccattcctccatcagtccatccacccatccgttcctccatcattccatccatccactcatccattcctccatcagtccatccatccacccatccattcctccatcagtccatccatccatccattctttcatcattccatccatccacccatccattcctccatcagtccgtctacccattcatagaggcagcaagtattacatagaacctgcaacttgtcaccacacactagccttgatatttgtggctcccgctctctcactcccccagttcctttcagacatctttagtttaaaggtgagctgaaattaagaagttggaaatcctaaccacgtgtggtgggattcgcctgtaatcccagctacttgggagactgagatgagaggatcacttgagcccaagagtttgaggccagcctgggcaacatagaccctcccctgacatttttggaaaaaaaaaaaaaaaataaaaaaaagcccttgggggccacaccccttggtgaaataaaatattttttttttattaaggcttcttttgtggtttgcgaaaccccacattttttttgttgggaaagagacaaggttttcatttaggttggctgaaaaaaaaataacaaagnnnnnnnnnnnnnnnnnnnncttccttttggtgttttggtgaacctgcaagtagttttctgattgggacaggacaaaggtctttacttcagggtttgcttgataaaagcatttccaaaaggttttacatagaaaccttgttccttgttgatattaatacaaaaaaaaatgttacataagctcttcacctcttggaacaatctctaagggttttcttttctttttttaaaaaatcatgccccttaagatgaaaaactttcacccatatcccctaacacatattttatatagagataagcatattagctctatgtagaaatatgtaatttataaattacatttgtatattgctttactaatataccatgtaccatatgaagcatactatagaataattatagatacagaatatagaataagatgagatataaatattaaaactgaagttccagtattctctttccatttggtgaccatgatcttagcataacaaaagtggggtaaatgtgtttaaccctgtgtttcccaaactaatttgtgaactcttcctccccaaactacttgtatcccttggaacagaggtccccaacccttggagcgtggactggtgtgggtgcacggcatgttaggaattgggccgcacggtggtgggtgacccatcattactgcctgagccctgcctcctgtcagatcagcagctgcattagattctcataggagtgcgaaccctattgtgaactgcacatgagaaggatctagattgcacactccttgtgagaatctaactagtgcctgatgatctgaggtggaacagttttatcctgaaagcattcccccaccaggccccctggtcttctacgaaaccagtccctagtgccaaaaaggttggggaccgctgccttggaacacactcaggacaaaaccagtctgtcatatgatggttactacctcatagttgtaaatttctgctagacttaggcaccttgactaactcactgtcttatctgctgtagaaatccccttttccatcccactcttatgtgtaagaaaagtcagatgcagctgggttgacatgtatctttattgactagggtgtgtgtgtgtgtgtctatcaagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggtaacttggagttattttctgagccaaaccttaatcctaagacttaatttytgggccagatttaagaacaagggtttcaataaccgatttctgactcaatgcaagttgtttgttagattttcccaccaaagagtcagtaaatgtgcagaagcagaagcagctcacctgagagatttgagggtgtagctccaagaaccactttttggtgaattttcatgtttttttactacatctattcctatgtttttatttttattttttttaaagatggggtttcaccatgttgcccaatctggtcttgaactctcttgggttcaagcagtctgcctgcctcaacctcccaaagtgctgggattgcagacatgagacactgtgcccgtcccctatgtttttatttttaaatgttttaaattactctttggttcatttaagactaagttatgctgcatatcacagtaaaccttaaaataagagtggctgaaataaatgagattattctctcttgttaaggaaccccaggctaagccacctgggtgccctgcagctcaccaaggaagtcagctccatctctctgctcctctacctagcatgtggcttctgtccttarggtctcctcctggaccataaggctgccagtgctctggccatcacatccacatggcaggccagaaggaggaagaaagaagggaaaaaggggtcctcccagctcagtgggctctcttaagcagccctgccaaaagtccatcatagacttccattcccttctgatttgttgggggttggtcacaattcacattacctagtggcaaggatgctaggaagtggattcccatcttctgggagcggtgcacctagctaagagttatggtcctgttaataaagagaaaagggagactggatgtggtggtgtgtgagcagaagcctctgcctcctcccctccctacatttcagaggatttcgagctaaaacactcttggttcacctgacaacaaaattactaaaaattggccatgtctgtcatggtgttaaagggatctgtgaccctctactctccctaccaaaaaacaaaacaaaactagattgtattaagccatcaattctgtctgtttccactagaggcactaatwggaaaatatgtcagggttttccatgaatgttttctacatcttgacaacatcctaaatagcatttctctatgatccacaggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtgagtacagggcatctcaaggtcaggggcacaggctttgcaatcagaaagccgggccgtagcccttctctgtgacttacaagctayatgatctgggcacgttgctcaacctcactgaacttcagtttgacatagattgaarctctttgtttttatttggagaacatttagatccaagaagctcttctaaggaacagagactgttttacagggttactgcaaagattagatgaggtcaggcatgaaaaatgcttagcacagtgcyaggtacatgataactattattatatgcttttgaaatgttgagaacccaactctgatggcggctcccatgaaaagcagcacatttctgccttttatgagtagatagttactcaggattcattcaagagcatttcaggtcagcattagagaaacacatttaaggatctaggtttttttcatcatgcatatgtaaacctctcaggaattctccatgaatatttgagcatcacagtttctttggtttctttctttttttttcccctcctttttccttcagtttctaagacacaactattgactgtcacaggccattctttttttttttttttttttttttgagatggagtcttgctctgttgcccaggctggagtgcagtgacgcaatctcagctcactgcagcctcagcctcctgagtagctgggaccacaggtgcccacgaccatgcccggctaagttttgtatttttagtggattcagggtttcaccataattggccaggctggtctcgaactcctggcctcaagtgatctgccctcctcagcctcccaaagtgctgggattacaggtgtgagcaccacgcctggccggcctttcagtttttaagaacagcccttgggcagctcagtgctgctgctcaagcagattttaaaacacgaatccccatctctaaaatgagacagatttacttctttttaaataagaagactaaacacaggaccacccttgatgtgttctgtttctctcttagcccatctttttttgaatggagaaaatctgggctttcacggcaaggttgtgaattgctcagcgtggccctttttggctcacccatggcaaaaaatggaaaaattttggaatgcaggccaatccaccacctcctaggtctatgcagctgccagcgacaaccagatcatctttactaattgatggcatgttaacgttggatggggacttcccccttgccttgcaggccctatttcctcccccagcttgggcagaagcctgagctgaatacttgccttttggccacacctctgggtctgtcattcagggtcttccacagattgactccagtcttctcttccactmctccctgaacaaactgttcttgccaccctccctattactcctacgcacttggctcatatctaccaatgtgcttttagttcatgcttttctgcatttcctgatatgtggatcctgtgtaaaggggcgccagaaatcaagagagagactggtcactggggagaggttgcaagtctcccttagctaacagcacccatccttcagggttcagccatgtttcctttctttaggaagccctttgtcagtgcggcaaccctgggatataaattcttagaacctttgcctagatatgctgccagacacttctctgaggaacagtttgttattttttctgtaacttagttcctcttcagcatttccactgcagttggaaatgtcgttcttggtgcctggccctgttaacatcttgagagcagggactgtgtcttgcccacctttatgtgtacctggcacttaagaaaatgcccaatatgtttgctattgaaagtcaaccttcattgccatacctttaaatgctggcaaacccaggctaacctttagtcaacactcagagcttacagatgctccttatttagtaagtaattgatgacgtaaccctttgagcaacacctgatcaggggatctttgggatatccctctgaatggcagcagttggaggcctaacatttacaggcacagacaacatggatgggtatgatttgttcttgggcctccaggatgtgtgtccatacttccattctcttcccctgaactcttctccaggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggtaaggaaaattccttctcccgagcatgctgttattggtggaaactgtaacagctgccgtttgttgaaccctgactaggatatcctcttcaccttttttttcctttggaaaaaaatttgttaagcagtcatgaccttgtagagtcccagagtaatctctagaaactcagagaccctttggctgtaagggtttttagggaatcttactggccaccaaggtgtctatcataataagggacttgggcaatatcctggcctaagcccaggcattttgaaagataactcctcagaaaaacacacctttatgaaaatgtttctacataaaacatgacaggtttttaaccggccagctcttccttcttccatcttcatggccattctccatggctggaggagagagcttcctgatgctgttttgtttggagacttgactctgaaatcccaggactcaaagtacctccacttgtgttttggaaagattcacactttatgtatgagggggaaatacctcgtcttttgcagctaggaacatctggaataaaaggaggaaaccattatgcaaacacctgggttagtgaatgaccaaggtctttcattttcagttgtgagttacttatagatcttcctctgtttatttatttttattattacataatagatcttcttctgaatattcttcaaccaggaaaagggttagaaaccttggggacattacctcattgaaccctcaaaaccaagcatcgttggcttttttacaaatgaagcatgcttggtctagacagacaccaaataccatgctgtcatcctcactggtgtcctttgatactgtggtcagcagccgcacttgaccacaaggtttataggcccttaatgacctggccttgtgcacagccgacaaagcaccttctaattatttcattttgtgcarcaatggagaggtgcatgaagactccattccaaactccaaagctcagggactttcttccgaacagtctatactctgttgtagtattattcccttccatcgacgtctgtttatctgtaaacagcatgccagagatctggaggctcttttatgtctcaagtatgtaaatgtaaacacttgtcaacttttgacattgttcatttaagagtgtttttctcctgtaggaagaaagaaatacagctgggaagttgatgtccttattcacagagaagggtaccagttgtagttttcagaatctgtttttagcccatagtgggttttatctggttggttagaattaggtggaaggagggaagagcagccaagcactgagcagtggtcatgggcctgctggtgcaatgatttgggggtaagagaagaccatattgggaaggtctacgtgagaaagtcagagtaaaaaaattgaggaccctttttgcagaagtggaggcttccaaactcagtaataagtgtcttctagcccctgaatacacacaaagcaagaatactttgtgtttacccactgccccctgaccactgctgaaggcagaaagggacgatcacctacagtacctggtttgggtctttattctctcattccagggagagaaccttaactagatggactgactgactgttcattggctttggttgggtagattccctgcttccctctataagtttgacgccaaaaaaggacaccgaccagcactgcagtcatagcaaatgtctcaaggagacccacagggtgttttcttcaaatacactactcacacacagcacatggagtcatggacaaacagcttaactgcccattgcctttgagaagtcctggaccaaaggccatagctcagccattgaaagatcttccttctgactgatatgtccctgcatagctccaacctgtgcaggcagaggatagggctgttccaaatgtcgctcacagagctgcctttgcctttctgcagatcccaagatacacacaaagcagttaacatgggtamataggccttcctctgtaggagagggcttctgattcttattctttcttatggcggaagagggtgttgagaggggttcccttgctgttggttctgttgaatcaggagcattaaatcttttttgtttttttttgagacagaatctcactctgtcacccaggctggagtacagtggtgcaatctcagctctctgcaacctccacctcctgggtttaagcgattctcctgcctcagcctcccgagtagctgggattataggcacctgccaccacgcctggctattttttgtatatttagtagagatggggtttcaccatgttggccaggctggtaactcctgacctccagtgatccacctgccttggcctcccaaagtgctgggattaccggcatgagccactgcgcccagccatgagcattaaagctaagatttgttgaaaatgaatttataaaaaactttagaaacattaactgctgagcatggtggctcatgcctgaaatctcagcagtttgggaggccaaggtgagagggttgctggatcccaggagtttaagaccagcctgggcaatacagtgagaccccatctctaccaaaaaataaaaataataattagcctggtgtggtggtgcacgcctctagtcccaactgctcaggaggctgaggtgggaggatcacctgggcccagaaggttgaggctgtagtaagctgagattgcgccactgcactccagcctggatgacagagcaaaactctgcctcaaaaaaaattaaataattaaccacagtagacatttatcaagtaaaaaaagaactttttcctgattctgtgctgcagagatgccttgtgttagtttttacctacttacacttcacacacctcactttcatgcctggggtcacaccgtacatactgctttcgcaccttgcttccttccctcaatgtgtcataggtacccttacatattgattcattggacctgactgccatgttccactggacagactcaccagaatttatttgaccaaatcccttccagatggacattgggttgctttagttttgcacgaccacagacagcaccagtcaaggtccttacacacatcaattaactatggagtctcccgccagcttaggtctgcgtgctacaagtggggttgtgggctcacagggcatgcgcatctgacagttgaagagaggacaccaactgccttccaaaagggcagtaagaaagtgtccttcgctagagtgagtggctcactgcagttcaagatggagcagtgggggaagcagctctgtggtggyagtctactgagtgtatccttccagtatggttcccaactaatctccatttgccactgaccaggccacagatggggaagtcacagccgtggaggaggcaccggtaaatgcatgtccccctggattcaggccctgggtacaattttggttttttcctttttgtgtttctgtgtttactcagccttcatttcagaaaatctgccatctgcttctgggattgcttaagccctgtgggtgtcctggtcattggtgtgcccctcactgatcagcccatcacgatgatccctgctttttctgtaataagatyacctttgcgtcaccatccgtgctccacgaatcgccagccgtcgtgtctgtgatcacgctcggtgcagtttgtctctgtgtttaaagagaaagacagacagctgtctgcagccctcctgctgcctctcaaagccgccacttgcacattcagtttctgttcagggggaaagccacccactgctactctctgccacttaaaatgcaccttcttttccaggccacaagcaactaaacctttccagatggagcctcttgggactcatagacattgctgtctctcacttttccactttcccgtgggtgctgctgggaattttacaaacagactcccgagtgattgctaacagttggtcagcatgacctctccagtccctcaggttctaccctgggtctggagccacttagacaaagcccataccacaatgggcagccgcattcccaaatcccggcctcactggcttgtagaattcccagcagctctaacccctgtagcttcaccagctcccgctgttgtctgctttacccagtgaccactgccttctgtttttaggtgaccgaagaggcctatgtcccagtgagtgacatgaacggcctgggatttaagccttttgacctggtcattccgtttgctgtcaggaaaggagaaatcactggtaagcacttgccataaaggccgtctcattctcacttgctctcacgagcttcccagaatggtgctggggaggtgtgtccactgtcccccagacccaggctccttaacccagggtcacgagttcttggtctccggtgttgggccgtgggctcctgaaactacagaatatgccacgtgtgtgtttctctgaagaagtggctcactgacaacttgcattactttcttgagcagtcccatgattctctctaggttaaaaactgctgtgtttagatacctcatgactgtcgggttcttgtttgcccctttttcctgccttctcttatttgacttttccagatgtgactttgacactgagtctgtcatacaggagttcctttctcccctcagcctcttttcaatggcccacttctctttggtttgatgctctatgtatccagctggtttcatggtsttctcaagtcctttctgagcttgattttgccagttgtagaaaactctttaagagttgtctgctatattttgtggaagccaaatggaactggaaaaaaaaaaaagaaaagagcaaatggtctctcccattgtgggacttgaatgttttaggcagcaacgaatgttcttgggtctggaaacctttattttgaatacatctgtgccttgggctctgcttctctggggaaggttgctggtgggcttcattgccccgtctctctgtgctccataggagaggtccacatgccttctgggaagacagccacacctgagattgtggacaacaaggacggcacggtcactgttagatatgcccccactgaggtcgggctccatgagatgcacatcaaatacatgggcagccacatccctggtaagctgagtcagcaggcccagcagggctccaccattcaggggcatccgggcagcctgcagacactcctcagccrctttgcagggagcagctctcggcagcaggctggrgaatgcagcgttggtacccctgtgaaaccaaacagtctgggaccctagcaggtccagctgatttctggaagggatgatgtagctcagtgtcttgggtcacagtgcaggcctttgggtctgtggttgtttatctttgtcactacgctgagtgtggccagaggtcaagctgggagaaaaatgggaggcatggtgagggactttccagcctggcctgcagagccctgtgtgggctggaggcttggggccaggtcagaggtggaagaagaggaccagcagccctggaagaagaggaccagcagccctctacaagggaagccagcccaggtttcatgggtcaccaaccagcacagtgtcaccagttcattctttctttttgtagttgtatttgttttttaatttagtattttgaataggtaacacattctcatggttcaaaaataaaaatgatacgaagaaagttttccttcctacccctctccttgaactagactatcataaatttttttatgttcgatttcagagtttcagggttttattttttatttttttgtggagatagggtctcactgtgttgcacagattggtctcaaactcctgtcctcaagcagacctcccgcctttgtctcctaaagtgttgggataacaggcatgagccgccacgcctggccaatttcagagtatttttaagactctccatgcaaacggaaatacagatatrtaagagagtgtcttcccagccttccctcatgtggacgaaccattacatatttgaccatttccctattggagggcattttggttcttcctgccctcgctgtccccagtsttgctgcgcaaatcgacttttcccctagtcacctcacactcacaaagatgtatctgtgagatttagttaccagaggaggcaatgctagggccccagtgcaggcatctatgattttgacagatcttgccaaattgcccttcagaggggctgttgcagttcacacgccctctggccatggagaagagcaccttcttttccacaaaatttgccagtagaatatggtatcaaatttttggagctttgccagtctgatggttggaaagaaacagaatctcagcgttgctttatttgtatttctcttgtgaatgagaccacacaacttyccctatgtctatttgtatttctttttctgtgaactgaacatttggatccacggcctgtttttctatttggttattggcctttgtcatatagtttctaagagcaatgtaaacattggagagattagccctttgtggtaggagttgcaaatgtttctctgagattggcatttactttagttgtctgtatgtaatattggtttaaagcaaaaatgtattatctgcttctatttaaatattctaaagcggcagatggagagagaggaaaaaatgtctttctcacatctgccatccacttccactgctggtgtgagttgtgtatcttttcagatgtttctctctgtatctacaaacatacatataattttattctattttgtttttaaaggaatagcataatggtattcatagtttatagcaacttgctttttttctttttaatgcatcatattatggataatttctcaagtcagtaaacatgggtcttcctcactctttttaatggcccatgagtagatcagcatttatttaaccggtcccctgttgtgaacacttaggtcttttcctgatgtgcacccgaacactgcagaaatgaaagtgcttacatagggctaggagtcggggtgggcagagaagaccactgtggggttgattccttacaggttgaatggcatgggcaaatggccttccaaaagccctttccacttaccttccctctggccatgggtcctttcaccacccagtgcaaaagtttcttccttatttgtcaggttgggctggtaccttaccttagcccccttcctcatctggagcagcttccaggattgtttttcttatgttgtgattgaaggaataatactgcgtagaccctctctgatgtcctaggatggcgggggatgggaggtgcatgtgcatctcyttctgtctcttcatgcctctgcttaggaggcgccagacctgtagagaggtggacgtcaagatgccagttgtccagggtcttcgttcaccccttaatgagcaccaattttgtttgtgtccttcgtaaacccagagagcccactccagttctacgtgaactaccccaacagtggaagtgtttctgcatacggtccaggcctcgtgtatggagtggccaacaaaactgccaccttcaccatcgtcacagaggatgcaggagaaggtactgtgtggtttacgtgtttatacgcctccagctgtccatttggagggtgaagtggacacggttccagggtggcttttaaaagtgagacaatcgaatggtagtatttgtcttgtcttttctctcgtgtaaatctgtttcttctttagagccgcttcgtcttctacccagacagacatttttgaagtcctttgtgttctaaytgaaatcagattcatgctatgaaatactttatgtgacttgtctggaatttaagtgtgttttggttggtgatgtttttgttcttgttgcacatgtatccacaagaccacatgacttactgagtggctctttttgataaagctgtgtgcccattcccgtggtattcatggataatcccaaatctgtggttctaatgggatttccgtgatggcagccagtgcctgatgggcagggacaatccacctctgccctccaccacccaccgtctcctatgtgtaattgatgtacacggctccttccttttctcatcccatgcatcctgagagtagagagagctccagggttacttgcagtgaagaactcagatgtttggggtttcttctcagtgggtgtttttactgcgtggactgcttcattctgacagatgtccctttgcccacagctcacgtggagtgcgtcaatccattgtccccagcatcagggctgccctggatgagttgttaaaaggaaactcttaaaacaaggcaactctctccctaacacccctgcatccctgttcccacttgtaggtggtctggacttggctattgagggcccctcaaaagcagaaatcagctgcattgacaataaagatgggacatgcacagtgacctacctgccractctgccaggcgactacagcattctggtcaagtacaatgacaagcacatccctggcagccccttcacagccaagatcacaggtagggttgtctggcttctggggtcttcctcgtgggaagtatggctgcctctgactgccaccctccktatcagacccctggcagcaggctagacgtctctttgagtttaggtttcacagagacttgttgaggaggagcaggggatggaatgcaattttggattagctaaatccttctcttgctgataatccaggaaaatgcgagagctagtatttggagcacacttttattgtgccagtgtgactctagggtgcaaagagaaagctctcagatggagtgttcgaatcatacttactgcaatagtgcatgaagtgcatgagcttagacatgcccttcagcgtcactactaggtaaattttctgctatcccttttacagatgggaaaactgaggcttggcaaggtagtggtgtagccaagttcacatataggtaaacagatccaggttatcaaattccaaagcccatgctcctcaccttgctgtgttcaggttatgctttcagtgggttataaggaagatgcacaaggcagatcctgtttccccaccgtatttagacctgtctgtgaagcagccagtagtactgtgtggaatgtggtcattgtttacctagaaatgcccacagccatgccaggcaggtatgaggtgccttcaactaacaaaaattcctatattttattttatttttgagacagagtctcactctatcacccaggctggagttttagtggyatgatctcggctcactgtgacctctacctcctgggttcaagcgattctcctgcctcagcctcctgaatagctgggattacagcacccaccaccacacccagcttatttttgtatttttaatagagatgaagtttcaccatgttggacaggctggtcttgaactcctgacctcaagtgattcgtctgcctcagcctctcaaagtgttgggattaggcacctggcccaaagattcctttaaaatgtggtccatgaggactcaagtctctaggtcctgccagcttcttgtctttgctgcaagcaggcatgaatcccatcattcttcattggttgggtctactsagtgttcaagsctcattttttttcacttaactttgtgtaattagttcttgcgtgttcatccgtgaacagcatatggcatggcagctctgtgaagccagggtaaccacatgtaacgggagtcctttttgggggatgtttcccagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggtgagctaggctacccttcctggctggagccaggacatcttgggtgggagatggggactcttgcagtcctttcttgggaatgggtagcacaatggagtgtgatgtgataaacctgctgggtcacacgcacgataaatgcccaagcgtatttgtgcattgtgatatygacactctggattgttgggtgtcaggaaagaggacatatttctatttctgagagtgtgtctctctcctgcttcctctccgccatccccttacaagccccaatctgtgttctggtccaggcatctccttcatcccccgggaagtgggcgaacatctggtcagcatcaagaaaaatggcaaccatgtggccaacagccccgtgtctatcatggtggtccagtcggagattggtgacgcccgccgagccaragtctatggccgcggcctgtcagaaggccggactttcgagatgtctgacttcatcgtggacacaagggatgcaggtctgtgtggtcccaggggagaggcccagagcttgtgggaaccgacttattttgctgaggcagcgtcatcttttcatcctaccaactccttttcctttstgagcatccttcaagctataggtccttstgcctgcattgtcttttatgcctcatgaccattggcaaaaatgggattgtctttgttttttagatgatgaaactgaggcttgcaaggtttagagccccctctgcactaggatctgaacccagagccacaacacctcgcaaacccctgttttcttatctgctctcccacccttgttctcagcttcccagcgtctctccaagcaaagaatgttgggttgattggccaagaccatggtcatctgagcagagcttttgtggaaatgaagcatctctttctgttttctctttgagatggtttgagttagattgtgtctcttccaagcttgccacaccccagtgcctccagtcatctgctttcttgaaggatggccacgctggtgaattctagacaaattctaacccggggagagggctggagaatttctggtcctggttgggagatactccctgttaaaccttcggatatgctgacctagctgaggtagccaggggctatttaaaaattcaaaatctcagatctggctgtggataaacccccaaggtggtacgtgcagtacttggaggcgtgagggcagaaggtcctccccagcagtttgtacgggacacatcatctatgggatattagtaaatatccttaaggaaaggcttctgtggtcaaaaccaggttcagcaggttatttcactatggggcttctcaggacgcttaacctactcatccccctctgggctttgcaaacgaggccgccattgctttctttctgctatgtagaaatagattgaggcgtaagggtcggatgtcctttctccattcatcaggctccctcttcctgaggagctgctgtcagaacagcctggggctgctgtgttgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctggtatgtgcattccattcccctccaggtgggatgcttgggttttctgtaaatgctgtgccttggcctctggcctgctcacaggagccttcttgggtcttgcagggagcccatttaccgtgaagatcagtggggagggaagagtcaaagagagcatcacccgcaccagtcgggccccgtccgtggccactgtcgggagcatttgtgacctgaacctgaaaatcccaggtgggcgtcggggactagtagggtggggaagccttggctccagccttcagggcagtgggtgcctttgggaaccaagtttaggcatggcccagaacacagtatccaagtcggctgtgctgaccttttcatttcacttcatttcattatgttcttctatgtttattttcacagagtctcatccaagaaaaacaaatgtttaccttgctacctttttcctcttccaaataaaaatagctttattgtgtcacatgggggaaacgtagatatgcttttagatttttagattaactatctgtcaaatagaatcatgtcagtgaaagaactggccctgccgatgccagggtctggaagtatttaagaggtggcagcccagcggcatccttctagtatttctctttcattcctgaaattagaacgagggctgtgctgcagaactcgctgggccacatctagccctttggtggtgaattgttcytcttgggccccgattagccagtcaacaggtcacacagtctgtctgaaatgtgttccaagttctttctataaagaatccttccagagggaagccactgtgagtgaaaattttgaggctcctctgcccagaagttggcatgtcctgtggaattgcacaaattctacagagaagggaaatctaaatcgtcttcagatggagcttgtgttgcgagctctggagagggggttgtctttctacactgcatctcccatccttcctaacgagtcacggagctgtcgactccgccttcttggctttagttaacaggttcttcttgtgtagtcacatcaacgtcgggtcacatgggaatgtggtaaagcctcattactgtagagttcagacatgatcacttaaaaagagctttattgggccgggcgcggtggcttactcctataatcccagcactttggggggccgaggcaggcagatcacctgaggtcaggagttcgagaccagcctggctaacatggcaaaaccctatctcttctaaaaatacaaaaataagcagggcgtggtggcgggcacctgtaatcccacctactcaggaggctgaggcacaagaattgcgtaaacctgggaggtggaggttgcagtgagctgaaattgcaccgctgcactccagcctgggcaacaaagtgagactccttctcaaaaaaaaaaaaaaaaaaaaaaaagagctgtactgatcgtttgtrgtcataaacagttcgtgtgcctcaaggtggggggaggaagtgtcacctcccagagagagcttggttcacattttaggtacagagttggaccctggctgccccatcctcatagccacgtctgctcactttccagtcacattggtgtactcatccactgtttttgtgggcatcttcccacctcaaaaaatagacatccacatcatctctttcatgaccctgataaaatgccatttcattcaatggaactattggtgatagaaaaagagagattccatttcatgtctagatgcatcaaccttcgttactcatctctgtgcctmarctcccatcatcagggctgctgtgacatttgccaccctgtgctcaggctgtgggctggatgcccaggagtgggctgggctggtgcatttcagatgctgccatgccttggcagaccgccctccacatttctccatactcccccaccagcactggggctgtctctccttctcactttggccaacctgatggaaaaacatggcattcagtgttcagtttcatatcttcgattactagtgatatgtgtactgtgttttcttttcatttgctttacatttctcatttggcaaaatttctgtgctctgcttatttcttgaggaactagcaagtatctgcagtgtggacgtttaccctttctcttaagtctcttccagctcttggccattttgttattcttttagttacttagtaccagatgactctgggtgaggctcgattttccactcattacccaaatgatcctctcggagatcccctcctccttaatggaggacagctcactaacttcagatgtcctccggacccaggttttgcggggcatctttgtcagtttgggctgctgtagcaaaatcacatgaactaggtggcaaccaacagaaatgtatgcctcacagttgtggaggctggaagtccaagatcaggtgccagcatggccagattgtggtgagggcctccttccaggctgcaaaccgacagcgtccccttgtatcctcacatgctggagaacggagggagccagctgtctgggactcttacaaggccactgaccccatcacagggtcgctccactttcatgaccttatctaatcctaattgcctcctcaaggcccatgataatcccatcacattgttgggggtagggtttcaatatttgaattttggagggacacaaacattcagttcattacatgggtgaccctcttttcaacctcccttcccttttctgtcctcaggggtcagagtcatgaactgctctgcccagatcctgtggggctggagggtgcagtttcatactggctctaggtgatggcagtgctccgtgccccrcatgcggccgcctggcctcaccacggcagtgcaggcacagtcgttggcatgacgtgagcagctcacggagagtgatgtggtcttgcgtcctagcactggtgacccgagacattgcttttctgaaagtgtggcccctggtctttggtttgctcaaagctttgctcacgcatggtttcccctctgccattgggacttacatatgttcacctttttctctaactttgtcttgttgcctaaaagaaatgccaaagcttcttgacggtaaaggatgatggctcttgttttctacccttacctatctgtggaaaggagcccgtctgtgcatgatggatgaccacgtcacctttggcaaaaagtctcagtgcccccagcatgggtggcctgaagggccctgcccactccatgctggccacagaagggcaggcacccagcctgaagggaaggaagcctgggcacctcacgtccaccgggctgcacacaccttgctctcggctgcttgccctgcatgtcctgccctgtctcaggcccttgccctaaccctcttctctcccccaacctccctccctctttcagaaatcaacagcagtgatatgtcggcccacgtcaccagcccctctggccgtgtgactgaggcagagattgtrcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccaggtgagcattgcgggcaggattttcacttkggaaraatagagttgagcccaggcagtgtgggcacccacatacttttttgccccatttgaaagagaagacttctgataggtggcattaagggcattatttaaaacaaggcatcatgactaagtctggcacagtttgtaactaagctttgctcacttacgtaaagccaaacaggtttcttactgggagcctccttggagcccgtatcttattagtgtgcacctgagtctctaattggggagcagagtaatacggtttccagagcatctttcagggctgatgttctgtggaacatactagaaagctacaaaactgactgtaagcatcctttcctgtggttgccgctggtgggaagatctgtagggaaaaaatggaacattctcatctttctctggcttggttaaggtgtattcattttttaaattttttatttaatatctttttctctcttgtttgttagagatggggtcccactatcttgctcagactggtcttgaactcctgggctcaagtgatcctcctgccttggcctcctaaagtgctgggattataggcatgagccactgtgcctggccggttaagatgtattcagggctgggcgtggtggctcacacctgtaactctagcactttgcaaggccgaggcaggcagactgcctgagctcaggagttcaagaccagcctgggcaacacggtgaaaccccatctttactaaaatataaaagaaattagctgggcatggcggcatgagcctgtagtctcagctactcgggaggctgagacaggagaattgcttgaacacaggagatggagcttgcagtgagctgagattgcaccactgcactccagcctgggcagcagagcaagactccgtctcaaaaaaaaaaaaaaaaagacatgtcttcagaggactccagatgtcctgtgaatttagttatcactagtgatgcttaggaaacttcagcaatggaccttggaccttgcttgggttctgcttggggttggagaaagaggaaagggctagcarcagacgaaacctagcactgcaggtttgaacaaggatggaagagggacaggggctctgtggggctcagtcactaaccaggtttctctttgctctcagctgagttcagcatttggacccgggaagcaggcgctggaggcctctccaycgctgttgagggccccagtaaggccgagattacattcgatgaccataaaaatgggtcgtgcggtgtatcttatattgcccaagagcctggtatgtattcagggttcacaagaggacattttccttgtttgaacatgattaggttgcaaggaacagaaatccatcaagtttgctgaagtcaatgaggaatctatgtgtatggrcacatgggacagcctcctagaaatccagttgcaagatacatggccagacctcttaagggtgggaacgcttgttctggttgccttttgcctttctccattagcctctctgcttcttgctttcattcaattgctccattctttccaccaaccagcctctgtctgcccacccatggctaccctggctggctgccccagaagagtggccttggcatctgagctccctctagcaggagctcttaaccttttgtgtgccattgactcttgccatctggcraagcctatggggactgttcttgggataatgttttaaarcacataaaatgaaatatgtcacattataaaagaaatcattgatattatagtacagttaccaaaatcttacaagaacaaatatgcaacatagaaacatgcatatcttcgttaatacattaaatcataagatttggtgacagtatattaactgtcatcaaastgacaaagtaataagtgaaaatgataygtcaaaataactgtaaaatgacataaaaatatatgatttttaatggtgatgtaagtcatatgtacttataatgtgctgtgatttcttgtcaacatttctgaagaaaggaaatggtaaatttcagttagagaatggtgaaaattaaaacgtaattttttccccattgaagtccatggatctgctgaattcaatacaggccatttggggaccctgtgagccccggttaagagtccctggccttaccccactaaggaaatcatatcggcccagcctcagccaggcgactcccactcaaccaatcagctgtggccattgaggagggctgggtctctctgaaggcattttagcccttggtgagaagcaagagtccactctgggtccagagtctctgaaatgatgggactttcctgtcctcataggtaactacgaggtgtccatcaagttcaatgatgagcacatcccggaaagcccctacctggtgccggtcatcgcaccctccgacgacgcccgccgcctcactgttatgagccttcaggtgagatgcaaggaagcatccatctccttggccgcaggccaccagtgagacccctggactcctgaggctgcttcaatgtccccttaggtgctgaggccccttttcacattttgaccacagatgtcacccagtcactggggagctttcctgtggcagagtcaactccccatacacttagggcggatgacacttggggcgagcaaaaacagagccacagtcaacaacacaccttaatgtttggggacacgtttgtttttaaaggtttatttaagagaaacaaaggaagcctgttcataactggttaagggataacaagggctttcaaaacaaaaccaacayaaaaataacagtgcagtgatgttttagcctgctgttgttggctgcctttcttcaagaaagtcagttgcaacttactgtgattcattaataagtgtgcagggaactatattaagagctttatcagtgttacctcagtaaatccttgcaatagcctgacaagtaggttctcttgaccccattttaatgatggaaaaacagagatacaaggaggttttgtccactgggaaccagctagtatgaggcagaacaggcacagtgtggctccagaacctgtatttttgtttgtttgttgttgttgttgaggcagagtctcgctctgtcacccaggctggagtgcagtggcatgatctcggctcactgaaacctctgcctcccaggttcaagtgattcttctgcctcagcctcctgagtagctgagactccaggcacgygccatcacacccggctaatttttggatttttcgtagagatggggttgcaccatgttggccaggctggtctcaaactcctgacctgaggtgatccaccccactcaacctcccaaagtgctgggattacagacgtgagccactgtgcctggccagaacctgtgcccttaacggcaacctctctaacccccacctgatgttgtggcacacggttgcatagtccatcccattaggataccaggagatgcaacatttttcctcgtcctaaacaggtcacttaattcaaggttgtactagcaccttcagccaaactaagaaccatcggggatgcctctgggtttttgcccaggacactgaaaaataattaggtgtctgaactgggagtagcaattaagttgtgaaataacatcgaaatcccaaagtatgatttctgggtaagagtttctaaatagccttgagctgcccccagttcttgaaaatattggattcattaaaatccaatctgatgtctaagattggtgatatcattggctttagttccatacacttggtttacatttgagattctaatcttactctgaggggaactgggatacctccagttgttccaaacattagtctttcatttagagacgtaaacagaacccaaaccagactcagtccacacattgaagcggcctcatccggagaataccaagggtactaactggttactgtggtgtagatgtttttcttgtgtttcatttaaaggcttcttaacagaagtgtcttttgtggccaacttaactaaaacctacggagggagataaacccagcacttattgagggcaggagctgccctcatgcatctcgaagatttctttcaaatctkccgaggcatttatctccctcttgaggatttagcggcaagcggattcaggtaatgtaaatgattctgtctaaaaggagctggtttggaaaaatcccctccaggaaacttctgtagagtgctctcgtcatagctgggtcataaatgtttcagtaagtgcacagcaggctgtttcttaagcttttgtaaccagctgctgccgcaggagaagtgtgttcatcagcatcgccccctgttcttcccgggtcatttgatgccgagtgatatgtaaattattgatcagagattttgcrgaggcccacgcaagcaacatctggtgctggttagcaaagagaggcatgtatcgttttgtcttgcttttgagactttttaggaaattggagtaggctggcacttggggtgggggtgggatgggagtgatctggtgatcaaagaccctctaattctgtgttctgtcctccctcctcastctatatcccctagggcagcacagtccaatagtaggttctgcagtgatcaaaatgcttcaagtctatgctatgcagcatgatagccactaaccatatgtgactattgaacatctgaaatgtggccagaggaaccaaggagctggatgtttagttttatttaagtgcattaagttgaaatatatgtatatatggcctcgtggctggtgactaccaaattagccagtgcagctttaggaccttgccatgaagatgtggttcttgggccagttcttggacctcagcatcacctgagaacttcagtcccagacccactggaaaagaatctgtattttaataagatccccagatggtttgcttacacattaagtgtgagccatgctgcttcagagttattgcctgaggagtggctgtccgaccaagtctaaatcaaaattactgacttgtaaaatgctgctgttcaggattggctagtcttaaaatatctcaaatgttgttgctcagctttgttcttaaccatctgaacttctaatcccctcctcccagaagaggagatagtttccaagacaaagtatggggagtgaaactgatccagggaagagcaaaagctatgtctttctatggcttcttgtggggatacaacctctaaatgcatattaatatttaataataagctgacgttttcgagcctctctgtgtatgggctaggccctgtgataaatgttttgcatgcacagcttcatttgatctttatagtagccctcgagatagatcgttattatgcccattttacagatgaggaaactgagactcgaagaggtttggcaccctagatatatagctaggaaatggtaggaaatccagatccagctgattcttaactgctatggagtactgccttctttgcacacgtagccctttataatatgttcctccaggtctgcccttgagataacaaacagcataacataaaactgtgttcgtgttcgtgagtgcatgactttgttagctgcagtatcctcttaaaagaggacacttttttgacctggaacatactgggttttctggcctgcatgggcattattttggatgctgagatgatagtccttttgaccaggaygtctcaagtatccaagcccagaaatcatctcttctaggctgaatcaagatggtttgcataagagaccatgcagatgcacgtctctgctatcttacattaaaaatgcagaatggctcacctgccctttgttgtcatatgttatatagaaaaacctatttgcatgagaactgtcacccacagttttrggtagggtcagtgtgtgccactgagcaggaacgccgagggccataacctgtctratgtattaaattctcaggaatcgggattaaaagttaaccagccagcatcctttgctataaggttgaatggcgcaaaaggcaagaytgatgcaaaggtgcacagcccctctggagccgtggaggagtgccacgtgtctgagctggagccaggtgagcaggaggcctgctggggggtcccagcaccagcactttccagcagaatgttcctgtaaatgtgtgtcccaagggagggctgatcagtttcattactgccagtgagcctctgaattccctttgctgttgccagatattgtttataaattagggtttaaacatgtgccagggatagggagaccctttatgctaggagagaatgctcattctttctttcttttttaaacaaatgctgggctgggtacagtgccttaacctgagaggtcaaggctgcagtgagctatgatgcagtgagctatgattgtgccactgaactccagcctgggtgacagagtgagaccctgtctccagaaaaaaaacaaaaaaacaaaaaaacacatacacacaacacaaaaacaaatgcttctttgttttctgttagtttttcagattccttttgcatgacattcatcataatttttctttcatattgtaacaacatcttacagatttttattcattgaccttatggcacgagtaagcatattttgatctcactttactctaaaggaaaagtaggttaatgttctgtaaatttaaaaaagaaaatctgggtctctaggcyctaatgtcctaagatttttcttgcttggtgccttggtatatggaattctctgatttaatcaactttaaagagacagtgttaccggtgaacataataaatttattaagtgtcagaaacttgaaggaaggtataaggctcaaagagttgctcaaagtttagtgaaggcctggccaaaaagcagatgatgaccccaaatgatcactagtaccacaggagaactgwgaagcaaatggtaaagatggtcagagcaggagagagaaatagtttctgcctcggtgagttcaggagggcttctcagaggaggtgacatttgatgtgggccttgatgtatgaggaggagacctatgattactgccttatagggcatttgttgtgtgcctggctgtatttgtatagtgtagttggaaatctaggctctgaccaggcatggtggctcacacctgtaatctcagcactttgggaggatcagttgagcccaggagtttgggaccaacctgggtaacatagtgagaccccttctctacaaaaaaaagtaaaaaaaaaattagccaggcatggtggcacacacctgtagtctacttgtgggggatgaggtgggaggattgcttatgtccaggaggtcgagactgctgtgagctgtgatcatgccattgcactccagcctgggtaacacagcaagaccctgtctcaraaagaaagaaaaaggaatgtaggctctgtgtgaacatttagatctatgtttcctagtaggcagaaaggcagtggggagcctcaggaggaacaartgtaaaggatggggtcagatcctggttttagtctgaaaggccaagtggcaagctggtgctcccagagtggtccatttgaggaagcagtggcactggaaatggagaggagggacttgaggccagagatctatggtggctatagagagtgagagagagaatccattccaaaatgttccacgtagcttagtgattgggtcggaagatgacagtgcagttatcagaactagggccagccaggcagagggtgggtgaggattggtcagggccttaaagggtttaatattttactttgaggggttttgaaggatccccaatacccaaatggagatgtttactagatcactgtgaggtttggtggcctcagccccaacagtccctcactgggtaccctccctcttctcttaaagccaatgtgcttcaggggaagctaactccaccccagacaggatttgaacccctacagatgtatgagatcattagcatgacacagttactattgattgcaaattacagaatacccagctcaagccaactcacacaataaaggggcccagtaagttgcataactagaaagttcaagacatccaagacaggtttcagcaatttgatttggtcattgagctgygccctgcaaggcgtcaaatatttctgctgttctgctttgtgggcctggttctggccttcctcttggtggcaggatggccttcctcttggtggcaggatggctgcagcagcaccagatgtcccaccttcacgccacatcaattaagagagacaccctctcaggattcttagaagtcgagagcctcctttcccagaagtctccagcaygtctgccttcccctctcactgacctggacacatgcccactgctgagtcatttcctgtggctaaagaaatgccatgtgctcattgactaaggcttagygaagaaggatttttccctgatccactcagggaccacacctggacatggcggtggagccagcttcccctacaacacattggctttaagggaggcggatggggactgttggaggatgttcagtgccaaaggacgtagggtgcacagcttcatggagrtgcacctctgtggagacgtccagaggcagggagaagagctttggggaacacaaattctgagagggatgaagagtactaggcaccagggagagaccgagagactacctggagaggtaggaggagaacaggctctgcaccctgggcaggagggcttcaaggaggaagcggcagtcaggtggtgcacaatgggtagatgttctaggtgcccacttcagttaacagattaccttgctacatgctgtgacccaaacgcacagccacaaacctgccctgtgggggcagttcctagctttgagcttaattaaggagcattaatgccagttggaaccgttttttttccccttcaagtggccaaatagagaaacatagaagaagtgaggttttcttttttcccttcatatatattcctttttatttcttgttatgccttcccaaaacagagacattgaacagtagttagaatggccatctcccaatgtttaaaaacaaactgaactccccaatgggtgaacaaagtaaagagtagtaacctggagttcagctgagtaagccgctgcggagccttaagtggtgaggtcttccaatttcagagtgctgtgtcttcaacttgtatcatcattttagtggaaaaacataatttaattttggtgaaatgagattcatctcgtgacaggattagtaacagcattcacagaatttcacactgaagaagtgaggttttctaaagaaaggaagtgttcttctgaggcaggggtcagagtcttgtcctgtgtttataggatttgcaatgtggatgcgtttcccttggggctgatgagggatacccagggggtctgtctggttctgaaatccaggatgctgagtgccaggctccctgtagaactgttgattttaaatgggccatctcagcttggcctccatcctttatcctcactgaactcaggggtgtccatttgcttgatttcaccctgtgcctttgctcattctcctagataagtatgctgttcgcttcatccctcatgagaatggtgtccacaccatcgatgtcaagttcaatgggagccacgtggttggaagcccyttcaaagtgcgcgttggggagcctggacaagcggggaaccctgccctggtgtccgcctatggcacgggactcgaagggggcaccacaggtaacccactcttctgcttcttgaagccttaactgaaccagctccagggaccaagccagatggaaatcctcaagccccatgaaagctttttacacrtactccccgtggaaactggggtcatgcacacttcggaggcgcttgctgtccaaagctgttttgggagttgcggtttgacccacgataaatccagagtgagagctcgatggccgtgttatcacacctcattactgttagttgtgattcagattccttcctctgccaagtttcttgactttcagaacaggatgctgatagtcagggaacacagcacagtgtcattaattttgagggtttctttgcctgcacagaattcatgatgcatccaagtgggctcctacccgtctgttctttcatggtaccaggctcccagaaatgcactgaagcagcaataagacctgtcccagcctatctcctcctctttttactctcagatcttaatggaggaggagaaaagactgaaatgttcaaagaattctgaagctttttagacccgttacaatttacttttattctttgccacagatgggacatgtttgattatgaaagatacaggcagtgaagaagtaaataaagtgagactcactccatcttctctcctcctcccccacctgggtctggaagcaaacggctctgggaagggaggaccttcaccctgtctgtcatctcattgtctgtcttcattcttggttgctgggttggttagctaattggttcattagacaagcagacacagagttttgcttttgtcttacagaaagaatcttactgtatccactgtgtggtatagcttgtgtttttgctttgacatcttaaagatctttccatgtcagaacagatcttcccctccttttcctggctgtagtgagaattcctgctgtgaatcgcagttatttgaacaggtggcatcgggtggtgcgcagtgagtgcgtcactgttatggaggctgccagggtggagagtcagtccttagtctttgcaggggaagtgcgcagtgtggactcactggggcatgtttgcatttggtgttactttggaccctcttgggaaagcagtatgtcctggtttcttgagtctcttgtgtgtgtacycccaccccgcataaggagagtgggatggagcagacttgcctcccaggggtgaggggtgagtgrctgcatggttgcctggcatccagccctaggagcaagtgacctgtgtggccaaggggccctctccgggtgcaggagtgactggtgggctggcaggctgcccgggactctggccaaagcagtggcctcagcaaagccacccacaggggtggtgtgagtgctgccagactccccaggcaaatccagccyggctccacgctgaactmtgggcctgcggcttgccttttgtgaaaggcatggtatcattttacmgtaagtgatgtccattttacagatgtggaaagtgagatgcagaggttgagtcactccccaaacaacactcccccaaaaagcagtcagctgggaggaggcagaaccaggaatcagtctacatccgtgacctcagagcctatgcgctgaacccccgagcttggccccctctctaagtggctggctcacccagaggcagtgactgcatccccagcccactttggggatgtcctmamccaggacccctgtcctcccagccactcaggagtactttccaggcagcagtgctggcacttgggccctgacaaggtactcacctttgagggcccaggtggggtcctctcggcacttggagcgcgtggcaggcttcaggccaggcctcacagcagctgctggggtctcccacactggccaggaagcatctcaccctcctgctggctcatgccgctgtgcctgggccctctcccatttccttttggctgttcgcacacctttttgggagcttgggtttcaggctgtgctctgcaagtgctggacgctgctgagagaaggagttgctcttgcagggaagctcctagccaggaggggagaggtacagaaccgcctgcttcaaaccctgtgtaaatattgctcttgtcacagggaaggcgccttgtttttccagccctcctgctcccaagcctttccctaaatatccattctgagattacacagctgcagtgtgcatggaatgaaaaggtatctgtgcttggccgccagagcgcccagtatcctgaccttctgaacaaagcaaacctccctctgtttttaatgggtgagtttgctgtatctcttggctcaagctttaaatggtccattctgtagattttggagtaggggaatgtggagaatttggggcgggaccctgctggaggcggcttgagaggctgggagatagaccagggagctccagattctttggagccgctgagcaattttcctaatgaaatggtccaggaaccccagtgtgctcrgggtataccagamgggcctccttccttaactgccttgaagaacaagcagtgctgygtttaacatgcattaaactcacaggaactgagctggacatatttgagggggtgggggaagaccgccacgcccagagatgttttgtggtgtcagatacaggttatagctagaggcagtggtgagagacttctgcttgtggatttttttccttccatcttctctcaggtaagtgctttagctccaagttggacagactttatgtttaaatcccagttctgctggtccccagctgtgtgactccagatgaattatctgacttcactgtgcctctgcttcctttcctgtaaaacaggattaataacaggacccacctaataggcttgtttggagctgtagaggaggtaacagccaagtagtagctcttgtcccataacccctgctttctsttttcccacctcgtcttccctgcccttttgggccctcacagtcaagatgaactgatttttggttggtcaaaatattgcattagggccaaatgggtgcggtggctcatgcctgtaatcmaagcactttggaaggccaaggcagaaagattgtttgaggccaggagtttgagaccagcctgggtgacatagtaaaactccatctctaccaaaaaaaaaaatttttaaagacgaacttaggaatgaaacagcttgttaaaaaatggtggaactttcccctgcagccacatcatttcaacttcactttaaaaatatctttttggcctggcacagtggctcacacctgtaatcccagcactttgggaggtggaggtgggaggatcacttgagcctaggagtttgagaccagcccaggcaacacagcaaaaccccatctctacaaaaaaatttaaaaattagccaggcgtggtggtgcatgcctgaagtcccagctactttggaggctgaggcaggaggatggcttgagcctggaagattgacgctgtggtgagctgtgatcatgccaccgtactccagcctgggcaacagaggaagactttatctaaaaaaaaaaaatattagtaataaggccgggtgcgttggctcatgcctgtaatcctagcactttgggagaccaaggtgggcagatcacttgaggtcaggagctcaagaccagcctggccaacatggtgagaccccatctctactaaagaaatacaaaaattagctgggcatggtggcgagtgcctgtaatcccagctamtcaggaagctgaagcaggagaatcgcttgaacctgggaggcggaggttgcaatragccaagatcatggtactgcactccagcctgggcaacagagcgagactctatctcaatcaatcaatcaataaaatatctttccttatcatcaccttacagctgcttcctggatggacacactgtctccttgttgctcacctcccgcttcttccctacgtagccccaggcctcagagctgctgcttgaggggcttcttggctgcacagattagataccatgatgaggttgagatagtgttgggggtggaccttggggcaggagcctcaagagcttccaggaacagctgggttgtgtttgagagttgcacgatagcagctcttttgtttttattgatatccagaacaataattctttctctggactaggagctataattaaaccaaaatatttcccagctggggcagtgtctagggctctggcagaagcatagccctgcatggggatgctatgccaggcatgccccatagagggcactgtagcaggcatgcgccagacctgatgactgaaggaggctctccctgggccagctaagttgtctcagggctgcagttaggggatctgaggcagctccactgcccatccaggggtcaagagatgagcctggcaccagagccatgcagacatggttcaaacccggctctaccactttctggttgtgtagcgtgactggccccctccctgagccgcagagtcatttgtgaagcaggaatcacggaaaggattccataccacatgcgtaaatggtgctgtgcacaggacctggagccggagtggggtacgcatgccccgtcagcgggagctgctgttctgttcctgtgcttgttgctggaattcacggcaaagtgggtgggctggcaggtcacagtggctgcacccggtmtrcagcacagtgcctggggtgagggytgaggaggaagggaggagatgcttggcctccctggcttctccaagtctacccggagaagaaaggacagtcagaggggcccacgcctcccccacacccctggagggagagctggactctggtggctgaagcagcacttcaggctcacagtgtgactcaggcttcttgccctcagccacaatggctcatgcccagaggagagaacagggtgtccaggctgttggtgcttgtgggcgaaatgtcagccatgctcctcctgccttggcctagaaaagggagcccccaccccgcagggcctgaggttctctctgccagaagttcagagctagtgccagtgggttcccatgccaccagggtgagccctctgtaaggggatctatgtgtgtccctcaccacggcctcagtgctcccaggaaagccctccaagtcatcaacacagcattttctattcctttctcccaggtatccagtcrgaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagygtcaaatacggtgggcccaaccacatcgtgggcagtcccttcaaggccaaggtgacaggtaacgaacaaccaccttcggagttactytcccttcctggggagctggttgtgtcagatcaatcatagtggaaactatggatggttttagatgtgttaaagctactttgaactttgaatgtcagtaaatagtatgagatgtcagagggcagtgtttgaaacttacaaaagtccacagagtggagccgtgcagaagttgagaaagcatgttaggatgttaggtggttttctatctctaacaggaaagaatacatattgaaatcttacgtatttgtttagatcagggyctgaaaaatcccctgatttctaattttcacttgaaaaataatcaaaaagttttcctatacttataaaaatgtgtctcctccaaaacactggaaaaaataccaaactatgaaaaccacttcacagccaccacccaaggtaaccaccataaacactgtagtaaatcccttccacacgtcatgattcactgttacataaagaatgtaggttcatcgcaggaaaattagaaaattcagatagaaaaatcatcctttctcatccacagaatcattttttgatatttcattatatgtcrtcccaaacttttacactgcttatacatagactattttatgtcaatagaaagatgtgaattccacaggcacatctttggtgggtagggggtggggggattgggagggtccttggccttgtcagccaaggccagactcatccatttgcccagaaagccagatcctagttgtatgggggtgggatcctaggggtttagaagacattatgggtgtgagatacaggtgtggtggcttttgtgttggggtgcgcgggctctcctggggttactgtgtagggtactcgcctgtcctctggctgagagacccctcttgatctggccattcatgcctgtccccctccctcctgtatcttaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagaagttccttcctggtggactgcagcaaagctggtaggtgtctgggccttttcaagggtggggtggggcaggggyaggctgggcaccctgggtacactggccttccctgctgaggtctcctgcagtgcccacccccatgtaggccagccgtttgcaagtaaccatcgtcatgaccctgttctcctgcacttaatatttttaaatgatttccttctcttttgccttttgaacttgggtatttatttgggtttcaagggtcggttgcctgggttctggcatccagtacacctgggctggaaacctagtaccgccacttcattcattcattcgtttgttctaaaacttatttagccatgtgaccttggaaagttattaaatctctttccaaaagtcagtttcctcttctcggaagtaccttccttaaggtgcttgtgagagtaaacaagaagattctcatagccaacacttagaatagcccttactgtgtgctaggttttgacacccataactcttaaacctcacaactagttcgtgaggtatgtgctgttctcattccctgtttacagatggggaagctgagctagggagaggtgagattccagtccaaggtcacccaggtagcaagtggcagggcagggattcgaacccacaccgtcaggctctatgagcctctgcttgtaattgccacrctctcccacctcttaggggccccagcattatcgtggaagcaccttacctttggctctcatatttcctcttcttcctgtgcctgtcctgatgcatccgggtggagtaaccaccttttgcctcctaggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcayttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctasagaaactcagagggcagagtggcagccaggcccacatgtctctcaagtacctgtcccctcgctcyggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggstctttggcctgaaagttgggaatgrttkggggagagaagggcagcagcttattggtggtcttttcaccattggcagaaacagtgagagctgygtggtgcagaaatccagaaatgaggtgtagggaattttgcctgccttcctgcagacctgagctggctttggaatgargttaaagtgtcagggacrttgcctgagcccaaatgtgtaktgtggtctgggcaggcagacctttaggttttgctgcttagtcctgaggaagtggcyactcttgtggcaggtgtagtatctggggcgagtgttgggggtaaaagcccmccctacagaaagtggaacagcccrgagcctgatgtgaaaggaccmcgggtgttgtaagctgggacacggaagccaaactggaatcaaacgccgactgtaaattgtatcttataacttattaaataaaacatttgctccgtaaagttgccttggtgttcttggatgatgtcgcttctgaataaattgtttaatcctaggagttcaacaccctcagcctgggtaacagcaagacccagcctctacaaaaaattaaaaaattagccagcatggtgatgcatgcctgcagtcccagctactcaggaggcggaggcaggaggattgcttgagcctgagaggccaaggttgcagtgagctgtgtttgcaaccctgcactctagcctgggcaacagagcaagacagtgtaacacacacacacacacacacacacacacacacacacacacaggcacatcgttggagccccagatcagctctcccaaccccttaagggacacaaaactagcaacttgttttgacaatgaacctgggctccttttgtgggggtggggtggggctggtaaacaagctgtcacctgtcaccctgctgtgcttattgttgctgctgcctctgtttctcttttttttttttttttaattttccttttttgagacagagtctcactctgttgcccaggctggagtgcagtggcaggatctctgctcactgctgcctccgcctcccaggttcaagtgattcttctgcctcagcttcccaagtagctgggactacaggcgtgcaccaccatgcctggctaatttttgtctttttagtagagatgtggtttcgccgtgttggccaggctggtcttgaactcctgacctcaagtgatccgccctgccttggtcttccaaagtgctgtattacaggcgtcaaccactgcgactggcctgtttctcctttttctagaagagcttttgattgctgaatgcttacgaggtacctagcacccctcctccgcccccacctcctcctcctctgtctccgcctcctccccaccccacagcagtgataccgctttacagatggcactaccacctcaggtgctgcaatgacatgtttgcagatgcaaagctcacttgggggaagaccctaggcccctgccttcttgaccccagggtgctagctctaccccctggtgataccgctgtggaaacaggagtccccagataggccccggcaggtgccacggtgatgggaaatcacggctgggcccccagccctccagatgggggttgggggtggagagaaaagcagggaagggagactggattcttctgacacctggctgtcaattgggatcaattgtttgcctctgagaggagggaggaagagagtggaggaaaggtcctctcctcccggagggagcwgccttatctgtggcctgcaccaggaagcactgcttcctggactcctatctgagaaggtccgtgggcttcgggattctgcagtggcgggcagttcccccacttgccaaagagtccattcaggctctgcccggtggggtctggccgggccacagtatcatgctagtttgcccacagaggagcacagggcgcagccattggtctctccactgtgaagcctggcggctttctgttgggggaggcagcatttgtaaattaacagcatgggctttggtgtcaggcaccccagagcttcaacgctggctctgccgttcattagctgtgtggccctggggaagtcgccttgcctcacctctctgggtggtcgtgaggatcaaataagagcccacagggagctgtaaggaacaattccctgccagagtctcagccactgctgtctgtgaccaacacctgctggaagtgatgttcctggcagaaggccgccccctggctgcttgttggcatctggggctacacttggttgtcccctgcatgggagcgatggtgatgttaccctggggtaaatttccccactagaagccactgcctcctgttacatcaaagacatcccagggtgggatgcacctctttatcagtcaatggctaggaccacagggcaacccttacctgcacctgggcttggctgctatggaaaccagctgtttgtgcaaataccttgaaaactttgaaacttgaccccggacaggcctggtgccaggtcctttccgacttttgtgttttctttccacctttcactactgactttgcctctttcctaccaggaatggacagggccgatggaggtgaagcggacagcagctgcactgccctgtagagattcccaggccctgcccacttcaaagcacacaagcccacctcttcctcatcacatttccctttgcaacccagggaggcactcaccaggatgctgccaagaaggaaacattttattaacatgtttctttgtttccgatgcacttaaaacacttgggcctcttgaccaagtctagttttaggacttcaaaggggcgttgaaagccacattttgatgactttggtgtaaaatgagtagggcatatcgggatttaatttcccttgaaagttgcacagacttaaaaattagcagaataggctagcagaataggccggatgcggtggctcatatctgtaatcccagcactttgggaggccgaggcaggcggatcacctaaggtcaacagttccagaccagcctggccaacatggtgaaaccccctctctactaaagatagaaaaattagctgggcgttgtggtgcagcctgtaatctcactactcaggaggctgaagcaggagagttgcttgaacccgggaggcagaagctgcagtgagctgagatcgtgctactgcactccatctggcctaggcaacagagtgagattccatctaaaaaaaaataaaacaaatagtagaataaaggttaaaggcaaaatgagtgcttgatccttgtcaacccgccaagtttatattaaaaatggggagtgttgctgttaactgaagtgcgcattagcctcagttctcagccctatggaagtagagtcaaggaaagagatggagtctttccaaatctccattaacttggagggggaagaggctgtataatctgtatatttcacgaatgaaaactcccagaaattagtatcttatgcaggtattttttccctttcacagtagtaaatcataatttgaggaagtaaaaatgtcacattgggggcagtaagggctcaggcaagcctggattcagtttatttttctggctttgtcctaaggatgctgcctaacgcatggtgggaggaatctttctaaacaaagagatccttctctgcttcgtgataaggcttttgtctgagcccccaggcccacggggaccggctcatgggcatggaatttagggagacctactccacagccctcacaccctttttctctcttcctcaagagctctcaagagcaggcaggaaatggagaatctacgagcctgacttgtggcacggatccacatatccaagggtgttttgtattttggactcgcttatctccccgggacaaagtacaaagatgaaagaatctgcaagccttttgttgcccatgtttctccctctgccctgactgccttgccaagataccaaaacacctctccctgtcgggggctgccctccctttctaggaagtggacgtgcttagggcaaagctggtgctgaaccccggcagggtgtattcagaggaggagaaaacctcagcagaagcaccaagtcctggaaatgccagcttcaggcccagctacaagcagcctgctccatagcagcagaataacctcgtgtagcagcagcattcagagaacagcgggtcacatgctgcaggttcaaaccggattccaagcccagcgctgctgcttaccaaccgagatacctcaggcggtcaccttctctgtgcctcactgctctcatctgtaaaatagggaaataatgggaaacttccattctaaaatcagatgaactccagaaaggcatctccccctgcctccctcccgctcagcacatccaccccgcaactggcctgggcaaactttcctcaacccaaagctgttgagagagggactgcctgagtgttgcagagattcggctccccaaggcagactggaaggggcaccccagctagggaaagggaggcttatggagaagccattaagcgtggtggctctaaggttgggctggggattcaaatcctggccctgccatgacctctggcaggcaggtcactgatccttcacagaaaactgtgcctcagttttctttccaatgaaatggggtaacaggacccaccccatagagtgttctgagaactcactgacaaaatatacgtaaagagcatttcaggccaggcatggtggctcactcctgcaatcccagcactttgggaggccaagatgggtggatcacttgaggtcaggagttcaagaccagcctggccaacatggtaaaaccccgtttctactaaaaatacaaaaattagccagatgtgatggcatgtgcctgtaatcccagtggggaggctgaggcagaagggttgcttgaacccaggaggtggaggttgtggtgagccaagatcacgccactgtactccagcctgggtgacagagcgagactgtctcaaaaaaaaaaaaaaaaaaaggcatttcacagagtccagtacatgataagtgttcgtgaaattactattattggtgtaaaggaactaagacattaagttctgagtcctaggaaagcagtgtggtgtggcagacagagtcttggtctgggcattagggttaggcagtatcagtaggagtgggtggggtggggtgggccaaccacagaactctgtctgaggtgggatgttggtggcctcagggagtggccagaaaggtgggaggagaaaggggtgagtcacatgcacctaggagggctccagcccacatgccagcctgttcttgtcccctggtttcagagcttcaccattttccctttgcataggcctaggccagtgacagacctgagggctgctcccacactgcgccatcccagggattgttagatggatggagcttaaataagttaataaactaagagtaagaaaattatcatcgtaagtaacactaacgctatgcactgagacttactatcacattttttaaaggagagtttgtcaaggctcagaaaggtttagtgactggccgggcgcggtgtctcacgcctgtaatctcagcattttgggaggcagaggcaggtggatcacttgaggtcaggagttcaagaccagcctgcccaacatggtgaaacaccacctctactaaaagtacaaaaattagccgggcgtgatgatgggcgcctgtagtcccagctacttggtaggctgagacaggagaatcgcttgaacccggcaggcagaagttgcagtgagccgagatcgcgccattgcactccagcctgggcgacagagcaagactaaaaagaaaaaaaaaaaaaaaaggtttggtgacttccccaaggtcacacaggtagtcattaatggtcaaggctgtgttaaaactcggtaaacctgtctaggaacggggccgtgaagttgtgcacggctccagacacagaaaacagaagccagaggaggctctcctagcgggccgttggcctccttgggcccgcggaaggcggccctttgggagcgcctctctgcaccgtcccagctccgctcccctctcggggaagttgtgggccgcgggggtgagaggacgactgcctgggttgtcgtggccgcagtgaccgctaggggtcgccttggacacgcgaaatacgtccgcgagcggagtccctgcggtggggaaggcgcgggctctcccaggccaggaggagggggacccacccacctctcttcttctgcgctggtaagtccgggggctccagcgcagaagcttcgggggtggggcagagaggctgtctggagttctagcagcagactccgccccgcaaccgattgactccagggtcctgccgcccccaagccccgaaactcctgacttcctcccttcacccctcacccccactgtccccagtaacagagccaatgtgaagtgcgcctaggcataatttacttgagcacatttcccgggcacctactgtgtgccaggctc

SEQ ID NO: 17727 - DNA, 80032 bp, Homo sapiens
  misc_feature (1)...(80032): n = A,T,C or G, or insertion/deletion polymorphism (see Tables 1-2)
gtggtttgtatctttgtgggatcggtggtgatatcccctttatcattttttattgcatctatctgattcttctctctttccttctttattagtctttctagcagtctatcaattttgttgatgttttcaaaaaaccagctcctggattcattgattttttgaagggtgttttgtgtctctatctccttcagttctgctctgatcttagttatttcttgccttcggctagcttttgaatgtgtttttctcttgcttctctagttcttttaattgtgatgttagggtgtcaattttagatctttcctgttttctcttgtgggcatttattgatataaattttcctctatacactgctttaaatgtttcctagagattctggcatgtcgtgtctttgttctcattggtttgaaagaacatccttatttcttccttcatttcatgatatacccagtagtcattcaggagcaggttgttcagtttccatgtagttgagcagttttgagtgagtttcttaatcctgagttctggtttgattgcactgtggtctgagagacagtttgctacaatttctgttcttttacatttgttgaggagtgctttacttccaactatgtggtcaatattggaataagtgtgatgtggtgctgagaagaatgtatattctgttgatttggggtggagagttctgtagatgtctattaggtccacttggtgcagagcagagttcaattcctggatatccttgttaactttctgtctcgttgatctgcctaatgttgacagtggggtgttaaagtctgccattattattgtgtgggagtctaagtctctttgtaggtctctaaggacttgctttatgaatctgggtgctcctgtattgggtgatatatatttaggatactgagctcttcttgttgaattgatgccttcaccattatgtagtagccttcttttctcttttgatctttgttggtttaatgtctattttatccgagactaggattgcaacccctccttttttttgttttccatttggttggtagatcttcctccatccctttattttgagcctatgtgtgtctctgcatgtgggatgggtatcctgaatacagcacactgacgggtcttgactctttatccaatttgctaatctgtgtcttttaattggagaatttagcccatttacatttgatgttaatattgttatgtgtgaatttgttcttgtcattatgattttacctggttattttgatcgttagttgttgcagtttctttctagcattgatagtctttacaatttggtatgtttttgcagtggctggtatcagttgttcctttccatgtttagtgcttccttcaggagctcttataaggcagtcctggtggtgacaaaatctctcagcgtttgcttgtttgtaaaggattttctttctccttcacttatgaagcttagtttggctggatatgaaattctgggttgaaaattcttttctttaagaatgttgaatattggccctcatctcttctggcttgtagagtttctggcgagagatccactgttagtctgatgggcttccctttgcgggtaacccgacctttctctctggctgcccaaaacattttttccttcatttcaaccttggtgagtctgacaattatgtgtcttggagctgctcttctcgaggagtatctttgtagcattctctgtatttcccaaatttgaatgttggtatgccttgctaggttggggaagttctcctgcataatatcctgcagagcgttttccaacttggttcctttttcccccttcactttcatgtacaccaatcaaatgtagatttggtcttttcacatagtcccatgtttcttggaggctttgttcgtttctttttactctttttcctctaaacttctcttgtcacttcatttcattaacttgatcttcaatcactgataccctttcttccacttgatagaatcagctactgtagcttgagcatacgtcacgtagttcttgtgccatggttttcagctccatcaggtcattttaggtcttctctatgctgtttattctagttagccttttgtctaatcttttttcactgtttttagcttctttgtgatgggtttgaacatcttcctttagctcagacaagttttttattaccaatcatctgaagccttcttctctcaactcgtcaaagtcattccccgtccagctttgttccattgctggtgagtagctgcgttcctttggaggagaagaggcgctctgatttttagaattttcagcttttctgctctggttccccccatctttgtggttttatctaccttcggtctttgatgatggtgatgtacagatggggttttggtgtggatgtcctttccgtttgttagtattccttctaacagtcaggaccctcagctgcaggtctgttggagtttgctggaggtccactccagaccctgtttgcctgagtatcaccagcagaggctgctgaacagaaaatattgcagaatggccattgttgctgcctgatccttccctggaaacttcatctcagaggtgcacccggctggatgaggtgtcagtcggcccctactgggagttgcctcccagttaggctactcggggtcagggacccatttgaggaggcagtctgtccattctcagatctcaaactctgtgctggtagaaccactactctcttcaaagctgtcagaaggggacatttaagtctgcagaagtgtctgctgccttttgttcagctatgccctgcccccaggggtggagtctacagaggcaggcaggcctggttgaactgaggtgggctccatctagtttgagcttcctggccactttgtttacctattcaagcctcagcaatggaggatgcccctcccccagcctcgctgctgccttgcagttggatctcagactgctgtgttatcagtaagcgaggctccgtgcacgcctcttatttttaatgttcggtttgcttcatgagtccttgtgtcgaatactattctgggcaatgattattcattaatacaaataaacattagattataggaagagtaagcttcccatgataaccgaagttattatcagatcctaaaagcaataattaaaaaccctgttcccaggtagaattgtaaagtggatgactcctgcatccagcattctcccattcatttttagagccatccaactccctcagtcacttcactgccattccctttcccaagccccggctgccgtctagatagtcagagcttcttggcccattgcaagcactcatcatgatgtttagccaccaacccagcattgtttggcatctttctaaatttcttggttttcactcaaacctcccataatccaaatgatgactgctatagaattccatcagaagacttatgaagacaagtgatttgacagcaaagagtcagaattcttaggttacagtggcaaaatcctgtaggctccatgtctgtcatatattgctatttgttcagtcttactttgatctactcactaaacaattcatcctctatagaactgagggtgcaaaggtggttggtagtgggttaaagaggaaagtcaaatcagaaatgaagaagaggttgaagagaccacatgtagattaaaaataaacttttttggggcattgattttcatttagtcacaatatttttattttcaaataacattaaagaaaaacaaacagtctttatgttttttaaaggagaagcagagaaatattacactattcctagtcaaaagtaatgttagcaggaatgtctagactatttctatgtgtttatttctctttattttagttaaatgatagatttactcacttgcaactaactcttgctatatttctcccatttcaaaattcttaaactattgtagctaaaaattgtatctattttacttagctgcctttggtagcatttgaaagtgaatgcaaaatttctggacaaaatagaaacaggtacatgggctaatataggaatatacacaatactgttaactgtcccaagatttttcattgattaygtcttccatggtgagatttcaggcataaaattggtttgggttagtacaaagtctggcccaacatatgcttacttgtagttcttcctaataagtcaaacaagctcacatttatggtgctgaatatattctagattcattgtatctgtagttgctaaaaatttagttccatgccttaggatggtattagaatgtccatgataagaaaaataagtgcagcaaaataaaagaaatgccacgcctatctttctgtattattttttccactggagaaggacagattttactcattaaaactacaaaagtctgagaccaactgctccatattcttttgtgttcgttaaatgttgttatttggaggtgacttaattagactaaagctagaagagaaaacaatagaatgtcaaagatgcttttcaagttgtaaactaacgttttaagttataaactacttgatactattttcttaattaaaaagatatttctgaatcgaaaagatcaaagcttctgagtaaatttagaaagcatttttttgtcatttacagaaaagggctttaagagcctatgttcctttggctttaagagctcttcactgtgacttcaaagtaatcattttcagattaataaactggagctcgtctttggaattatcagtttttcttttattacagaatctgaggttagccagaatccatctgcagaacatgaggcagaagggagaaacacctgacaaggtgaggccttccttaactattttaacacaagcaattaaccatttatactcacttaaaagcagacagctgggatgatggtgtctgctaaaaaaaaaaagtgtaatgaaatgttctttagttttttgatctttagtaaaatttcatcttcgtataaaattttattaaycattccactaacttgttacttctccactccacctccccactccctttagaatccttagtttgaagacataattctttaaatgatctgtctcagggaggggggatcttgttacttttaaggactgcaaatagcattataaactttgtttttatttttaaatacgaatatcgactgaagctctcaaatcaatcaatattgttgccaaattttgtaaaacgcactgtcttagctctctaacgatagagttctaatataaatgtaaaaaccaacctatcaacatgttttcaaaaatactttttgtaaagaacagtacaattttgtggtgtccaaatattcctttctttcttacaaaatattattggatctgtccagttcataaatattcctgccctctcttcctccctccctgcctctctctccctgcagtttttttgatgtttgttcttttctttccattttctagttattaattggttcaatggatgacctttgtgcgacactgttataccttatcagcctcgccagggcccccgcgccgcccaatcccagcaactctggttctcctgtgaccccaagccttccagatccctgggtttccccccacgggactgtcacattcttccccgccggagacgccagtcgcggggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtccgagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagctkctgtccctggaccttcttctgagggtrgtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctytccagccgcccagtgacccaagcttaatcttcagcaccacttggggcgaccttttcggtgcaaacctacgattctgtttctcaggattcctccccatcycgcttcgccccggaaaagctgacaagaacttcaggtgtaagccctgagtagtgaggmtctgcggtctccrtggagagctgtgcctggaagagaaggacgctggtgggggctgagatcagagctgtcttctggcccagtwrcccccatgcttctgtcatggctaacagttctaggggctggaatggtcgtcctgcacttcktgcagaaactcctgttcccttacttttgggatgacttctggttcgtgttgaaggtggtgctcattataattcggctgaagaagtaygaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcaggtagagtatggggtgtggtctgcctatacagaatggcagcccacctgctttcatacccttttttttttctttaggataattcgtaactaatattttgggtgagtgaagtgtgcatgttaagagtacaaaatagttttatgattctatgctggtttaacaactgtctcctcccttcaggcacgtagtttcagaaaacttttatgaaatctctgcttcctaccattttgagacagggacagttttactgctattggttccttcagtgagtgcaagaacacacagagaacttggtcacttctaaattttatcagctctgacaaaatggtgaataggaaagttatctgacttcattgtgacacgtctacctacctctaattgtactttatcagggatgactacatttgcagaagagatatgtttaaaggaaggtacctgaattcctttcttcatgtctgctcttattttatactgtctgcaagctaggacttgcctagcaaggttgcgctcccacctgtgagccagaacgtgggctcttggcagactctaggagcctttctgtttcttcttcttatccttccatgcatccttttctttttttgactaagttctacccttcctcctccccctgccttggagttaggacatcttaggctacacgtattttcactgaactgtaaagaaaagcctggggtttagtggctaattagtaaagaagctaggaagatgggttgcttaatgaaatagaagtgaaatatgaaaaatgatacttatttggtgtaatctaaatggtttatgcagagtcttcttcaatggggaaggaaggtgcggaaagaggaagatccattgcaaggaccataatgaaaatatttaagtattttagattaatagatacataccaataccttgtataaagtttttaaactcacagaacaatatggaaaaatatatttataccctggtgatctctaaggtatagaacttttcaaataacctttatgatataatatttgtatatcaaaccaaagtgagttaggcagtatatggaaaatgggctagcccttcaaggctatcactgttcctagttcttttcagttcaacttgtggtctgataaagtggcaaatgtatactttttcttatttattattattttttattattatactttaagttctagagtacatgtgcacaaagtgcaggtttgttatgtatgtatacatgtgccatgttagtgtgctgcacccattaactcatcatttacattaggtattcctcctaatgctatccctccccactccccccaccccacgacaggccctggtgtgtgatgttccccaccctgtgtccaagtattctcatttttcagttcccacctatgagtgagaacatgtggtgtttggttttctgtccttgtgatagtttgctcagaatgatggtttccagcttcatccatgtccctacaaaggacatgaactcatccttttttatggctgcatrgtattccatggtgcatatgtgcctcattttcttaatcaagtctatcattgatggacatttgggttggctccaagtctttgctattgagaaaagtgccgcaataaacatacatgtgtgtgtgtctttatagaggcatgatttagaatcctttgggtatatacccggtaatgggatggctgggtcaaatggtatttctagttctagatccttgaggaatcaccacaccgtcttccacaatggttgaactaatttacactcccaccaacagtgtcaaagtgttcctatttctccacatcctctcccgcacctattgtttcctgactttttaatgatcgccattctaactggtgtgagatggtatctcattgtggttttgatttgcatttctctgatggccagtgatgatgagcattttttcatgtgtctgttggctacataaatgtcttctttggagaagtgtctgttcatatcctttgcccactttttgatggggttgtttgatttttttcttgtaaatttctttaagttctttgtagattctagatattagccatttgtcagatgggtagattgtaaaaattttctcccattctrtaggttgmctgttcactctgatggyagtttcttttgctgtgcagaagctctttagtttaattagatcccatttgtcaattttggcttttgttgccattgcttttggtgttttagacatgaagtccttgcccatgcctatgtcctgaatggtattgcctagattttcttctakggttctaatggttttaggtctaacattkaagtctttaatccatcttgaattaaattttgtataargtgtaaggaaggtatccagtttcagctttctacatatggctagccagttttcccagcaccatttattaaatagggaatcgtttccccatttcttgtttwtgtcaggtttgtcaaagatcagatggctgtagatgtgtggtattatttctgagggctctgttctgytccgttggtctatatctctgttttggtactagtaccatgctgttttggttgctgtagccctgtagtatagtttgaagtcaggtatcgtgatgcctccagctttgctctttttgcttaggattgtcttggcaatgcaggctcttttttggttccgtatgaactttaaagtagttttttccaattctgtgaagaaagtcattggtagcttgatggggatggcattgaatctataagttaccttgggcagtatggccattttcatgwtattgattcttcctatccatgggcatggaatgttcttccatttgtttgtgtcctctttttatttcgttgagcagtggtttgtagttctccttgaagaggtccttcacatcccttgtaagttggattcctaggtattttattctctttgtagcaattgtgaatgggagatcactcatgatttggctctctgtttgtctgtttttggtgtaaaggaatgcttgtgatttttgcacattgattttctgtcctgagactgctgaagttgcttatcagcttaaggagattttgggctgagatgctggggttctctaaatatacaatcatgtcatctgcaaacagggacaatttgacttcctcttttcctaattgaataccttttatttctttctcctgcctgattgccctggccagaatttccgacactatgttgaataggagtggtgagagagggcatccctgtcttgtgccagttttcaaagggaatgcttccagtctttgcccattcagtatgatattggctatggatttgtcataaatagctcttattattttgagatacatcccatcaatacctagtttattgagagtttttagcatgaagggctgttgaattttgtcagaggccttttctgcatctattgagataatcatgtggtttttgtctttggttctgtttatatgctggattacgtttattgatttgcatgtgttgaaccagccttgcatcccagggatgaagcccacttgatcatggtggataagctttttgatgttctgctggatttggtttgccagtattttattgaggatttttgcatcagtgttcatcaaggatattggtctaaaattctctttttttgttgtgtctctgccrgactttggtatcaggatgatgttggcctcatgaattagggaggattccctctttttctattgattggaatagtttcagaaggaatggtaccaattcctgtttgtacctctggtagaattcgttgtgaacccatcttgtcctgcactttttttggttggtaggctattaattattgcctcaatttcagagcctgttattggtctattcagagattcaacttcttcctggtttagtmttgtgacrgtgtatgtgtccaggaatttatccattttttctagattttctagtttatttgcgtagaggtgtttatagtattctctgatggtagtttgcatttccgtgggatcagtggttgtatcccctttatcattttttattgtgtctatttgattcttctctcttttcttctttattagtcttgctagcagtctaccaattttgttgatcgtttcagaaaaccagctcctggattctttgattttttgaagggttttttatgtctctatctccttcagttctgctctgatcttagttatttcttgccttctgctagcttttgaatgtttttctcttgcttctctagttcttttaattgtgatgttagggtgtcaattttagatctttcctgctttctcttgtgggcatttagtgctataaatttccctctacacactgctttaaatgttttccagagattctgatatgttgtgtcttttttctcattggtttcaaagaacagctttatttctgccttcatttcgttatttaccctgtagtcattcaggagcaggttgttcagtttccatgtagttgtgcggttttgagtgagtttcttaaccctgacttctaatttggttgcactatgggctgagagacagtttgctacaatttcttttcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctttatatccttgttaacttttggtctcattgatctgtctaatattgacagtggggtgttaaagtctcctattattattgtttgggggtctaagtctctttgtagttctctaaggacttgctttatgaatctgggtgttcctgtattgggtgcatatatattcaggatagttagctcttcttgttgaattgatccctttaccattatgtaagggccttctttgtctcttgatctttgttggtttaaagtcttttttatcagagactaggattgcaacccctgcttttttttttttgttttccatttggttggtcgatcttcctgcatccctttattttgagcctatagtgtgtctctgcacgtgagatgggtctcctgaatacagcacactgatgggtcttgactctttatccaatttgccagtctgtgtcttttctttgggacatttagtccatttacatttaatgctaatattgttatgtgtgagtctgatcctatcattatgattttagctggttattttgctctttagttgatgcagtttcttcctagcgtcgatggtctttacaatttggcatgttttagcagtggctggtactggttgttcctttccacgtttagtgcttcctttaggagcgcttgtaaggcaggcctggtggtgacaaaatctctcagcatttgcttgtctgtaaaggatattatttctccttcacttatgaagcttagtttggctggatatgaaattctgggttgaaaattgttttctttaagaatgttgaatattggcccccactctcttctggcttgtagagtttctgccaagagatcagctgttagtctgatgggcttccctttgtgggtaacccgacctttctctctggctgcccttaacatttttccttcatttcaactttggtgaatctgacaattatgtgtcttggggttgctcttcttgtggagtatctttgtggcgttgtctgtatttcctgaatttgaatgttggtctgccttgctaggtagggtaagttctcctggataatatcctgaaaagtgttttccaacttggttccattctccccatcactttcatgtacaccaatcaaacgtagatttggtcttttcacatagtcccatatttcttcgaggctttgttttttctttttactcttttttctctaagcttctcttctcgtttcatttcatttcattcatttgatcttcaatcactgataccctttcttccacttaatcaaattggctactgaagcttatgcatgcatcatgcagttctcgtgccatggttttcagctccatcatgtcatttaaagtcttctctatgctgtttattctaattagccattcatctaatcttttttcaaggtttttagcttctttgtgatggtttcgaacatccccctttagctcggagaagtttgttattaccggtcttctgaagcctgcttctgtcacctcatcaaattcattctccatccagttttgttccattgctggcaagtagctgtgatcctttgaaggagaagaggcactctgatttttagaattttcagcttttctgctctggtttcctatctttgtggttttatttacccttggtctttgatgatggtgacctacagatggcgttttcatgtggatgtcctttttgttggtgttgatgctattcctttctgtttattagttttccttctaacagtcaggaccctcagctgcaggtctgttgtagtttgctggaggtccactccagaccccgtttgcctgggtatcaccagcagaggctgcagaacagcaaatgttgctgcctgatccttcctctggaagcttcgtctcagaggggcacctgcttgtatgcagtgtcagttggcccctactgggagatgtctcccagttaggctactcgtgggtcagggacccacttgaggaggcagtctgtcggttctcagatttcaaactccctgctgggagaaccactgctctcttcagagctgtcagatggggacgtttaagtctgcagaagtgtctgctgccttttattcagctatgccctgcccccagaggtagagtctacagaggcacacagcccggtttgagctgtggtgggctccacccagttcgatcttccgcactgctttgtttacctagtgaagcctcagcagtggtggactcccctcccctagccttgctgccacctcgcagttcaatctcggactgctgtgctagcagtgagcaaggcttcgtgggtgtgggacccaccaagccaggcacgggatatagtttcctggtgtgctgtttgctaagaccattggaaaagtgcagtattagagtgagagtatcccgagtttccaggtaccgtctgtcacagcttcccttggctgggaaagggaattccctgaccccttgtgtttcccaggtgaggcgatgccctgtcctactttgctcacactctgtgggttgcacccactgtccagcaagtccaaatgagatgaatccggtacctcagttggaaatgcagaaatcacctgtcttctgcgtcgctcacgctaggagctatagactggtgctgttcctattcagctatcttggaacaataaaaacacaaaggtttacttctgagcactcattttaatcttgttttcattacgggaggaaagggtctaggagcaaatgtaaactccaagttttgctaataattgataaggccgtaagttctgtttacaagggccaaccaagagggccacagtgtccctgaaaaaatggaracattccaaagccggtttcctgagagattcatcttaaagtacataggactggctacttctcaagatagagcattcaggcttttctgttgaccgaattgttgtttaactaggaccaattaattttgcagttttacttgtgccagcttttactttgcttgccaataactaattgcattgttttcttatttttgtttttaacaccaacagtcagttttttgtatttaaaaaagccactttgggatactgaagttttaagccaagactatttagttgattggctcggtaagtaggtcactggagaagtcacccattctttctggcataccttcaaatataaatgagatatatgttttccaaagatggaaaaattctattttgattaacagattttgtaataagatgtagcttagatcatagtcacttttatacttaaaatactgtgttgttggcatctggagtctcatttgtgaacaatataaacatactgtttttagcacattaaatttcagatttcttggattctcattggatgtttctgatggtgtactattaaatcattatacccccagggagagtatattgaggtagaaagatgaatcatgtggttcagacggaggtaagccagacagacccaaattccatgtatggtctgccacttcctggctgtatggttaaagataatatcatcagttaccctggatctcactgaacttagttgtaaaatggtgatgataccatctgattcacagtataattctgaggattaaatgacacatcttttgtaaagtggctagctgagtgcctggtatgtactaagtagatcttattgtatttaaatgattgctattatgattatagagtaatcctggggcttttaataagggatctcatttggattttgcagctacaaccttatttgatgttagctagtatatacagtcatgaatcacttaatgacaaggatacttttcttagaaatgtgttagacgggccaggcgtggtggctcacgcctgtaatcccagcactttgggaggctgaggcaggcagatcacctgaggtcaggagtttgagaccagcctggccaacatggcaaaaccccgtctctactaaaaatacaaaaattagccgagtgtggtggcagacactggtaatcccagctacttgggaagctgaggcaggagaatcatttgaacacaggaggcagagattacagtgagctgagatcgtgcaactacactccggtctggggaatagagtgagactccaaaaaacaaaagcaaacaaacaaacaaaagaaatgtgttaggtgattttgttgttgtgtgaacatcatagagtgtacctacacgaacctagatgacatagtttactacacacctaggcgctgtggtatgggttattgctcctaggctacaaacttgtacaggatattactgtactgaatatcgtaggcaattggaacacaatggtggtaagtatttttaagtgaaaacagaaatggtacagtaaaaacatagtggtatgatcttatgggactactgttgtatatgcagtccctcattgaccgaaatatcattatcattactatgtgttagcagtaagttaatgacagagttaggatttgagcccatgtttacctgatatcatgatgtgtatttctcacattcagacttgccacttctgtaaggaggcatatcctttctttacattatttttgctcctgacagtattcaagcatcattccctttcagtaaatacatgttcaacagatattataaataaaaaccccagagtcagtgcctccatggccagtaaagaagaaaccacgcattatcagtgcttagaacactgccttttctagctactgaaccatgaagccatttaaacttcctattaaaatcaattattttcttttgtaacagaagtaattgttgatctagctgagtctaggaatgaaaaagaaaaaaaaaacaaaaagccaaacagcctattctactaaatacaagtagaaatttagaaatgtcctgaaaagtaaaacagatatcatgtatggatatcatagtatgtaggtaagataataaaagttcacatgagctatgtattttatctatcggcatacataacactttctataaaacttaaagggggccagcgcggtggctcatgcctgtaatcccagaactttcagaggccaaggcaggtggatcacctgaggtcaggagttcgagaccagtctgaccaacatggtgaaagcccatctctactaaaaatacaaaatcaaaatcagccaggtttggtggtgcgtgcctataatcccagctactcaggaggctgaggcaggagaatcgcttgaacctgggaggcggagtttgcagtgagctgagatcgtgccattgcactccagcctaggcaacaagaatgaaactccgtctcaaacaaaacaaaacaaaacaaaacaaaaaatccaaaagggcatttatttttcctctgactctttttcttagtctttaaaaaacaattgcctttatggttgaaagtcatttggagaattacaatggcttgattgttaacaagaacatttgttaacaataactacaaactatgcaccatttcagtgtaacagtttactaacagtgcaaggctgcatgcattattttgtgtttatagagaagacacaggatttttacttcttacgaagagaaatctgaaatgcttcaaaatatgttgaacagcaaaatactatcaaatctaaattgaaagagttccgggtaattgaatagttttttaaaggtctctatttataagtataatgatttaatatgtggtgtattaagaaaggatggagaataaaatatataccatatgcaagtaaatctgaagccttgtgggtgcctactatgtctaaagtgctttgtaccttttgggagtgatgattagtaacattgacatcaacacaaccaggaaatcccaaccatatcaccaccctcaaaaccagttaccaaatgaacagtggagagtggacaactttttgcaaaaatatgcgaagtaaattaaaagttagcaagtgttcatgtgtatcatagtttttattatgccattcattcactcattcatccagataataaatacttgttgaatatctcctttgtgctaagtcctgaaaatttagcagtgaacaaaacaaatttcctcagttcaagagtttacaacctagttcttgaactattccttgaggctgcatcaacatctgtttgtgaattggcaaagagagctttatgattggagggagtcactgtaaagacacacagagcacctgaggcaggtgaggtcagtggaaaaggtactcaaagtagatggatagagaaaaggtgagagagaaaaggaaaggggtgggggaacaagggagaaaaggagagggaaagggagaagatggagatgagggaatgagcaggaggagaaaggaggaaaaagacaaaggtaagcccttcaggcttttatgatttagcatcagaaaatctgaactctagttcccatgccaccttgcctagatgtatgagcttgagtagagtatttgcccactataaccaggcttccctcgtccttaaaataaggttaatatttacctatcatggctgtaagtgttgatcaccaaaaataatgtataaaaacattttgtaatctatgaagtactttaaaatggcaagtattcttatttatcatcagcagcattataattatgactaaacatgccaaaggatatagagataatagcatacaaattttaaatgatataaaagcaccccaacattgttctgtttgttttaagtaaagagaagagcatagatcagtagatggtaatcttggcagcagataatattagcaatatcagagatgaaaaattgggggaaaggttgaggtttaatctcaaacactttaattttcaataagtttcccagagaaatttgggatgccatttgatatatgttctaatccaaaaatacacagatataagacttctgcaagtatttttgagtcttcagactgtgtgggaaggaaataatagtattataaaaattttaacatttttcttatctgtgtataaaaaacttggtgtcttaatattggtaacttttattttcatattttgtatagcctgaatgtgtattttttcagttacatcaaagtggaattgacagtctcagaaacattggactatatagtatagagaccatgttttgagtctgctctgcaacctactaagctgtgttaccttaaaaaagttacttaatwgtttaccatttcagtttctaaaatatarcactttacctgtctcccaaaaccgctgagagtgccttttagttagccttgagtacatggcaaccattatttttgttagtgacaataacaagagtaacatttgcctggtggtttagctgaaatcttttcctttggcttattcctaaagacagttatcagataccagccatgatagaaacttcacctatcacagtgcacattatctggcgtggcctatgaaacctgtttggaattgcttctgtataacttatgaaaaatagagtttttctaaaatgtaccaaaacaatgtgtttaaggttctatttcaaagaaaccacactattatttgaagctacatggaaatgcctgaatacatagttctaggaggtataacttaaaaatagaaggcaaaatcattataaagccaataatagaatgcatacatgatgatggtcccataagattgtaatactctattgtaccttttctaagtttaaatatatttaaatacacaarcacatattactgtgttagaattgcctgcartgttttcagtacagtaacatggtgtacaggtttgtagcctaggagcgataggctatatatcatacagcctaggtgtgtagtgggctatatcacttaggtttgatcaatgattatcattcagtcttgtgtgaattaaatgtaaagaactcaacagaataccaggatcataaagtatattcaacaaatggatgcaatcattatttttaactgcataatggcagagacagccacccatagtaagaagtcacttttgctcaggtctcttcatttgagatttgttgtatggagggaaacccacgtagtgtgttacacaaccttagtgagttggctttaaacagctttcttgtcctctccagtagcagtacatccataactacttcccaaccctcagtggccaaggttggaatgctctcagacacaagtttggagtgaggtcgttagctcttctctggccaaaaagaagaaggttcttctactgttaataacaaagaggtcatgagggagataaccctgatggggtctgagtcttgcagaaatactaccttagtattcactgccttttaaaaatatatatatcatttacttactaatgagtctgtctgtagatcgctttggtctgcatttactcttctaatttcaccactttcttactgaaaaatagcaagccagatgcaacatgccttcttgtgccatttcagtaataattattcattggcaacaggagatgtgttagaaataacatcaaatgaagtgttcractttttcttttttgtataattttggttataataatataatgtataaattgtgttattatgttataataatattcaatctgctcacctcaaaaatgtgggaacaactgagagtgaaaacacataaacccacttagaaacttgtgtgcatatattcagggcagttaaatcatgtcaggaaaaaatatgttattgcaatagaaagacttgtgcttctgttattcatgagttttgtatttcactcctcgagaactttgctatgttaagtgaggaatgaagcttcaactcaccctgcctggttatgcccttttgggtgggaagaggaagggcatggtctgacttggaaacaaaacaggccagaatcactagaagcacttctcccatgtaaggacctggattcccaatctgttgctctcccttccagggtctatcatctcctcttttcagtcttcaactttctatttaatgagcttgagctcattgtatgtcctcatcatcatcatcatcatcacaaccaacagtagtagtaataacaaccaccaccacagcagacaccatttaaggaggactgattctgggtcaggcaccacaatgaatggtttatatagaccatttaattatctcaacaactgtataagttgtatggagtcacttttcaaaagaggagagggagactcagagaaatgaagtgacttgtccaaggtcacacaactagcaagtgtcagaagcagtgtttgaatccagattctctggctgaaaatcctatactctagggaatcaatccagaattccagtgttttgctgaaaccatatttttttgtttttaagccagtggggtccacagtgtatgttggaacccattcttgggcaataattttgcctatttaatcatcaattttcttagaaaccagagctacccgtgcattatgtgaaaagcctgttgaactgctctacatagtaggatggtaactataaggatgtggcaagatctctaatttcactttgaattctaatgttgctttgcagtatgggaagctaaagttaaccatttgtagctgaataccatattaggtttattagtgcataaaatttaaaagttgaaatgcttaccaatgtattaacaaccataatcaatcaattcccatgccatatctttgaaagtattagcttgttttatgtagaataatgtagtttttagtgcagcataaataatataactcatactaatggcatattagagggatacataaaatttttacccatatattttgcagtctcaaaaatgtgaataagatctaatgttgatgaagaaacaagaaatcaatttgtaaaataaatgctaaaggattttaggcagggattataattaacatttttgtacttgcaaccccacctaatgaagtacattgcatgtgggaggaaaaaaatatgtaatttttgaatgaacatgcttctttgaaaacagaaattaagcctacaatgtagactttgttaaaggtcatagaaaatccagctgtctggctgggcgtggtggctcatgtctataatcccagcactttgggaggccaaggtgggtggatcacctgaggtcaggagctcgagaccagcctggccaacatggtaaaaaccccgtctctactaaaaatacaaaaattagttaggtgtggtggcgggcatctgtaatcccagctacttgggaggctgaggtaggagaatcacttgaacctgggtggcggaggttgtagtgagccgagtttgggccactgcactctagcttggaggacagagtgagactccatctcaaaaaaaaaaaagaaaaaaaaatccagttgtctcattttcctgcagtagtttacgatcaaaatggtacaaatttcagtttctgtaaccagttatctatctagcacctaatggcatgcggccaggtagagtgagcagaaggatggaggagaacacacatcattcttttgagatgcttataattctacaggtatcaatggtaatgcagtgaagcataaatcctcatgagataaagtcatttccttaaagtatttaaacaaatgctattttgtgtcaagacaatattcagaatttactgttaaaggacatgaaaagagtttttttctttcttttcttttcttttcttttctttttttttttgttaagatggagtctcactctgtcccctaagctggagtgcagtggcgtgatcttggctcactgcaacctccgcctcccaggcccaagcgattcacctgcctcagtctcctgagtagctgggattacaggtgcctgccaccacacccagctaatttttgtatttttagtagagacagggtttcaccatgttggccaggctcttctttaamtcctgacctcaggtgatccacttgcttcagcctcctaaggtgctgggattacaggcatgagccaccrcgcctggccaagattcattttattaagaaagactggcagtgataatgattctttatcccctgcatgactcttctttatcccctacatgactcttttattttaactttctctatcctcacccacatttcctaccactattgaagaaataattttgttacactaaattctatttgagaattctaagcatctcacctaaataaaattaattttaacttatgaaagaagtgacattgtatctcctctgattcctaggaaccttctcactttcttttttcttgctgtaaaaattatcactcttggtaaatactcagtttctttgggctctagaattccaacaaagatttggagccacacttattcatattttaactttcttggcacttatttccccaatttagacatacatatcattaagaacatataaaagtttgtgctgggaatttcttattctagatgagagattttgaaattaaagtaatgagtcagttcagagatttgcacttacaagttcaaaacctgagaaagagtcattacarcaaaatctggaacaaacattaaaaagaaagtctagatcctttgcttatccagtttttcatgtttctaacttgtcactcctcctatcatccttggtgatttttcacattttgccaaagcaatctatatacagcarcatgatgtgtgtgygttaagtagagctaggcattttccctggattcttatattttacttagayttgttatagaaataaaaattaataagacatcttaaggctatgaaccccactttccaccacatatcaacttcattataatttctgtattgccttctattttcatacaggttttatttataaactgcttagtcccacttgacatatttatcttgctgctgctttgtgatcaatctgggttatagatttcatgaaagtaaatcaagagttttcccccaatgtatttcattgtagtagaactaacccaatgactgatagttggccttttgagggaaccagatactgatttatgtttccagggaaatgtttaatgcagaactctgaattcaaactcaaagcagaatatatcttgtgattattttaaaatttttcctgaaaaaattagaaaaaatataattgctttaggtgtaaaggtccacattttcatgtacagaacttgagcattctgatccgggtttttttttttttttttttttgagacagagttttgctcttcttgcccaggctggagtacaatggcgtgatctcggctcactgccacctccgcctcctgggttcaagcgattctcctgcctcagcctcctgagtagatgggattacaggcacccatcaccatacctggctattttttttgtattcttagtagagayggggtttcaccatgttggccaggctggtctcgaactcctgacctcaggtgatccacctgcttcggcctcccaaagtgctggaattacaggcatgagccaccgggcctggccratctgtrtctattttacatttagcaccattattttttctttkttgccatttatttcttttatgaggtaattttatagttttagagttagtctatggttagattactaattctaccatccaccaacttgtgagcttgatgtatgagtttcctaaggctgctataatgaagtaccacaaacttggtggcttaaaacaagcgaaatttattttctcacagttctgggggctagacatccaaaataaagctgtcagcagagccatgctccctcagaaggatccaagaattttttcttgtctcttagcttctggtagttgccagtaatgttggacttcccttgcattaactccaaaaggccagtgggktactattgtttaatatccccaaggacgttaatatagattttaagataacctatatagcactcagaaatcccttgaaccttctaaatgtatagcatattatagaaataaggaagtaaaatcagagttgccatgtagaatataaaagttgaacttcatgtcagagatccatgctaaagtaagggagtggtgaatttaaaaagaatttaaataatataaataattgtatgcctgtctactctggagaaaaaaatgatgcttcacttgcttacacaaaagactgtataggaatgatgacattgtttcttttgtatcccacagagtgttggttacctcagtgcttaattatttcctcatcaaggacccagtcccaccttctgtctctcttgttttcaccactactcctctcttgaacagatgatatttttttcctgggttactgggcaaatcaggaaggtctggttaagtttcacagattaactcaacatagtctcacctcaccagttgctcctttgttatccttgtagcagatccttcctaagaaacttgtccctttttctttctgaaccttaaattgccaatcacccaaactgtgaattgtaaacattgtacccaataggtaatttctcagtcttcacctctctctcccaccctcccccattttggagtccccactcacttaacttctggctttggaatgatttctaaaccacaatgatcttgtgatttcagagcagtcggggattctcccaaatgttttgcattacagtggaactgaagagtaacctgcagacagcttttggaataactagctactgagttgtacttcaaggaaaatgtttagtgcagtatcctgaatttagattcagacagagttttaaatagttttatttaaaaattggtggagggaaacccataatttgaataatggagtctcttaaattcagtctgaattggactgcttgcattggtctgtcaggtgataactaaatttccctttcagttggtcctgttgaaacggaaccataaaatgactgtgatattacttatccaacataagaaggaaatcagcattttatttacattttatccctgtttcaatacacaaaagcaactccaaagtgaattgtttgagatttaaggtttgcttaactcttcccaaccctttggcttttagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtatgatccaattcttttgaaggctaaaatgaatgcgasaaatttgcaaagcaacagtgttgggcaaatttctaccatgtgtagtgaccaaccatctgagaatgcatgcttgcaagaagatgtaaggatctcagaggctagaactttccaacttggatggaaagttaattatcttaacttttacttgaaaagtcattgtgttcatttggcatttgtctcatttgacaagattttcttaaagtttggtagtacaaagggcatgggagtatccaaacaccttgatccagtctcattgctcagtgtatgatacttgatacttgattttttgggcaagatctttgttagcttctctgatcctcaaatttctgatatctaaaatgaagaaattagtttaaatagtttctactgattcttttggatttaaaaagtgttttaatgtacttgaaaacagttctctatattcctgtgtaaattattaaatcctaaacataatccaggtataccggcaatttaagcacctgttgctggctctcctgattttggtcagggtaattgaatcatgtgacaaacaggaactcttgaaggcactgcaggtttggactaagatacaaaataaaatcaagtaaataagctttattttaagtaaacaacagcaataacaataataaaactgcctgagaattcaaaagaagggcctggcacagtgactactcacacctgtaatcacacactttggaggccaaggcaggaggattacttgaggccaagtgtttgagaccagcctaggcaacacagtgagacctcatatgtacaaaaaaattaaaaaaaatagccagatgtggtggcatrcacctgtagtaccagctactcaggaggctgaggcagttgaatcattctatcccagaagttcggggttatagtgagctgattgcacctctgcactccagcctgggcaacagagtgagactcagtcttaagaaagaaaagaaagagaattcaaaagaaatgttaaacttaattgatttctaggaaaaactgaatggtattaatggtagcctaaataggctttcattattagtttgaaaatgattgttgatttgacttagacatattaagagtattgttactcatttcttgtgcataggttgtgagcaactattgcatagtaaaatttttcttacattttaaaaatctattcagttcctaattgtaatcccttttagactggagaatataatttttttttacatgattagaacagttttgataaatgaactgaaaagtgctaatatgtgtgtggctactctgtccagactgagggagcttctttctcagattgttcaggctacctaatcaggtctattgaataataacaggtctagaagttggcagattgaacagatacacagtcccttaggacaaaaggaatggaactagagatgacagctacaaaattttagaaaaggaggtgatgactgagtgtggtggcagacaccgcagacccaagaagctgaagcttatggtgaagccttgaagaaaattcatttgcccccaccaaaccccagaaaggctcagaaattgggtaccaggtacctcaaagagtagaaaataaatgtgaaactataagcaggaaactttatgggaagtttgtttaagaaggaactatagtcctggattgcttcttccaccctgatagaagtcctgagacgtaattctggaaaagatgaacttctgaaaataccaggaagaacagaggtttaaaaagtaggggatataaaagaaagtctccctccctataaatatrtatatatgtatatagatagatatacatatatgtatatgttctctttaatatatataacttcttttaatacttgactgttttaatctttgagattcttgtctgaggaatctgaatagcccacatgtaaaaattgaaagacactgatcatgatggattcccccaacagaatgtcctggacagtgaaaccaactagtaaataagtattcttcagacacagagattctagttaatattttgtttgtttattttgtgtttttgtgtctgcacttttaaatataaactgatagtcagtagtctccagatatttgaaaaaaatcctcctgaatatattctagattagattgagaccaatacaaacgaaagataaaaaggatgttggagaaaactgacaagatagagaggagaaattttcaaaaaattattattgttaatattctgaaagatggggacaaaaaagtgtcaataatataaaaataacatactacaaaaagaggaatattcagagaacataaktgttggaaaatctctcaaaaagtaaagcaaaaggtaagagaaggaaaacaggataggcaacattaggaaaccagtgattctgtccaggagggctgatcttcagaaaatcaagagttctaaaaatgaaaggatgaacacacaaataaatgtaacagaaaaaagcaatgggcaaaaagaacagaaataaggaaggaaagagaagaatggggtgtgaaaattattttgttttcaaattcaaaaatatctagaactataagacctgagttgttagactgaaaaagcctaaaaatttcccagygaaatggatagatgagactggtcccagtaaaagtcatcatgatattacagactactgaaaacaaatagaagattccaaaaatgaaaaaaaatagaaataccatgttgcatccaaaggataagaaatcagaaagactgataattgctcaatatatatactggaagtcagaagattatagagcaatgccttcaaagtcctgcgtaaaaatgactacttacctagaattctttacaagcagccattcaagtgtataggtggaaaaaaaagacatttycagncacataaggactgacaaaaacttacctcccaaatgctctttatcagatagctactgaaaccaaatgtgtgctaccactgtaattaatttctagaatcttagatctatccagaaaggccaacgataaaattacatagcgtttgagatacaggcctacttagcagcctgtcaaaggagcgttgctaaagtcagaatggcctcttttacaaagcagatagactactttgatatattttctgtcaattgctagtgtagttgttatcagtatcatcttctttctgttacttcctttctagttatatgaatatgtatgcatatgtatatgtatgtatgtgtgtatatatatttcctgttcttttcttttcttccaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtaaggctttattttctttttgataagttttcaaaatgtctaataattagaacaagtatttattaacatttgaagctgtatcggtagaatttagagtgattatatgcatattattttattataacacaatatttattttaaaaaaactacacaattttatggcatattcagtgttttcctgaggtgaaaagaacagttttctgaggatttggccatgtggtcggagctggstattggctgggcttctctctccttgtagtcactcaccctcaaacaaactaccccagattcctcaaatgtagtagaaatgttccaagggagtgagtatggamgctgcataaatcttaaggcctagtcttgaaagacacataggttattttaccttcattccattgatcaaagtaagtcatgggccagcctagattcaagattccagggctggagaaacagaagccacctcttgaagggagaaggagcaaatttacactgcaaaagtaagagccctgaagaaattgctgaggccatctttgcgaacagtctgccatagacactcaataaattagttggtagagcktgtgactcagtagattccattcataaacatgcaagattatgtgtcagtttctagacctcacataatatacaaacagtggagatcatttgctacttgtatttgtctaaaatgctgtaatttttagaatagaatatttagaatatgatcaatatccaccataaatgaagatgagatattaaaagmcattaaaatcttcagtggacatacattgttgtcaaaattaggttctgcagtcatttaagaacttttttgttagtactatcttgctaattcaaccttactaacagttgacctcaagatatgttgaggtggccgggcgcagtggctcatgcctgtaatcccagcactttgggaggctgaggcaggtggatcacgaggtcaggagattgagaccatcctggctaacacggtgaaaccctgtctctactaaaaatacaaaaaattagccaggtgtggtggcaggcacctgtagtcccagctactcgggaggctgaggcaggagaatagtatgaacctgggaggcagagcttgcagtgagccgagttcgtgccactgcactccagcctggatgacagggtgagactccgtctcaaaaaaaaaaaaaaaaagatatgttgaggctgctttaaggtttaaaaatgaataatatgtatatattccagttcacaagtaagtgaatattcttggcttctatgaagaaggatgactcttatcaatagccatgctctaatactttaactcttttacttattttgactgttgcttttctcctgtgtattgcaaaaagcatattttcagtcaaaatttagaattacaatattttaacagagtttttggacggtaaaaattagtgtttccaaatgagtttgatataaattattgatgatgagttattaaagttttaaaatgagcaaacatgttctagacagagaaacatcattcatgttttatgttcattctgcctttgaatttttttccctagtgcctgtttttgtcttttcttataggtgccacttgtgtgttaaagaagaaattttcagcragccagttttggagtgactgcargaagtatgatgtgactgtgtttcagtatattggagaactttgtcgctacctttgcaaacaatctaaggtaggcgtaatcattatcagaaaaaaatatgtcagaaagaataagtattgagatagaaaaggttatttttatttctttgtttatactctacctttgttactggcgggtctttgttcttagagcttccaagatagtggcaggtgctacctagatggtggcgggcagctcccaagatggtggmaagccttgtgttctctgatctggggttcttggcctcacggattccaaggaatggaaccttgggccatgcggtgagtgttatagctctattagaagccatgggtcatggaagagaaccgtggaacccagcgactagtgttcagctggattaggacgaacctgggcacttagccattcaggaacaatggcgagcctctagcccgattgggagcggcaatgggcaccttgctggatcagaagcagagcagacaccctgctggatctggaggggtggaagtcagcagcgggtctgcgatggcggagatcagcagtggtggacggtgagcaaaagctcagcttgagccagaataaacacagaccagaagagtatgcagttgcaagatttaatagagtgaaaacagaactctcatacaacgggaggcgacccaaagcaggttgccactgccggctcaaatgcctgggtttatatctggatctttgtccctccccctgtgctctcaggtgatagatgattgactatttctttacctcctgcttttagcctarttggtattttagtgagctctctttatgacctgattggccgggtgtgagctgagttacaagccccatrtttaaaggtaggtgcagtcaccttccccagctaggcttaggaattcttagtcggcctaggaaatccagctagtcctgtctctcaccttctttcagaacataatttagctgacttacaaagatgcgtgcaataccccaagataaaataagacaagtgaaagaaaataaacagagagctatccaagaatgtactaatgtgctttgtactgtagcaggataggactgacccaaagactgtgtttagactaaaattaaaatttctataaacataacacgcatcagattatgaaattagattcatgctatgtttacagaaagcaattattctaaggttaaaataatcttttaaaatgctgttctttaaaaaaataactactgaccactgacactgattataatttattttctattttttcttttgaataagtgattatattaggatatctttttgttttactttaaattaaaaaaaaaamcccacattgctttgatttgcacttgtctccttaactgaagaagtcatttccacattcgtttgatcaactgccaccatctgaaaaacagataagcagagacagttgcaatagcctgaagtttatctttattggttcatttgtttttttgccctcagaagttattttctttttcctggtttcgtttatctctccaaatgcttcttctttaactttatgattttctaaacattcttgagactataaagaagttactttctttaatcaaatttatttaattctttatattattttattattataaattatttatcttttattatctgattattttaaacatcagatccacatcagccccttcaagaatgacaatagagtaggatattgccctacgtggggtggggcaacagaaccttggcctttgagacccacctttccttgactagaggatctctcacttatcacctctgccatcatcacatctgcttaaggcatgaatggtgtgctgggatatcttctcttctctttggctaaaatctggccatgtaatttttcaattaattacccagagcacagctgacactaggctggaggcatttaaataagactttttcattttgagcttggagttcaccaaggagaaacctccagtcgagyttctgacccacctcccygtggcagaagccatccttactcattttttgyctggartgcttcaaataactatagattccacagattcatagccaagacaaagagttccagataaatgttttacattttttaaatatttttctcttcaaggagaccttgcctcaggtaagggaggtagtcttaatctaaagaaccccaataatacacttagaatgccacaacctcacatattttmtcttctagttttcattgtactttttggtaatgtgatatctggactaggttaatttagggaattaatgccctccagtaagattaaggtcaccttcagttgagatttcatgactttagtacagaacacagtaggtgctacctagtgaagctcatctgctttctaaaccatgtgctccaccattcctgtttcctctcatcctttaatagtgacatcagtttgtgtaatgtcattgctcagtaaatatttattgaatggttgaatacatgaatttacttatttctaaaatttaccaacttaatgctgcatttagtatcttcatgcaattgagctaatgtaggttttcagaagtgaatgtaaatagccaaagtatrtggatacttttgygatttatagaaaatatttctaaattgctgttcaacatggttgaagtgatttagaagctcatgcacattgtaggagtatgcctgttgcacagtgtctgtcagtactgggtgttattaaaaatagtggttttccagttgtgcttcttggaaaattagaagctcttttaagctccctcaaaagtccttgaaacatggtgagtaagagtaaaagcaggccaatttccaaggcccaccctttcaaatatcatgaattaaacccaatttcctgagctcctcaataatgctttgtttgaacaaaggatgcctcagtggtttttaattagaaaaagtaaattcgattatttacttttgtttataattttatagactagaaacaaacatwttaatgtgctctgttaagattactggcaaggtgggacagttttccagctgtatttccctttaaaaatgtctcttttgtgtcttgtactcatttatttgtctggtacataatgttttaccttatccagttgaactcccacttcatataataaaggtattaatagtttttcatattgattacaaatcttttctcagtgtttttctttaaattttttaaagaaatgaaatattctttttaactctctgaatctgtattgcactgatttggaggaaatattatagcttyggagaatttgaragaactgagaattgaaaacagaatrcctgattgctttttaattaatttaatttttaggggtgggcatggtggttcacgcctgtaatcccagcactttgggaggccaaggtgggcagatcacttgaggtcaggagtttgaggtcagcctgatcaatatggggaaaccayctctactaaaaatacaaaattatgtttttgtaaaatacaaaaatacaacatggggaaacgatctgtactaaaaatacaaaaattagccgggcgtggtggcgagcacctgtaatcccagctactcgggaggctgaggcaggagaattgcttaaccccgtgaggtggagkttgtgtgagccgagattgtgccactgcactccagcctgggtgacagagcaagactctgtctcaaaaaaaaaattaatttaatttttaattttaatttttaactaaatctcttcaaagaaaaaatgatgtttatcaaataatctgcaaatgcttacctgaatgcaaactgaggaggaaagaaggaaataaatacagctttacccaaaggraaacttaataatttttttttaagcagagaagcattgtactacctaataccctttgttgaactcacacaaaatgagtacaagctgttyttggcattaaaaattaggaaaaggagaaagtcattctgttatgacatcttttcccttcaaggagatcttacatttttgctstccaatattcctttcaatgacattcccttgaaatgaaggggcagtttctgctgcccagccagtacatcagtggattcaggtagagccagagaatgaacacgtgacatggtccaggtccttaccttcaaagaattaaaattgaatgtctcataagccatggtttgaagccccacagacagttatttaaaagaaagcaaaaccatgtggttttaaaatagattcagatttgttgacaatctcagggtaagtagcatattccaaaggaaatttacctgcaggcagaagtcagaatgtgagttgaatgtttatgtgtagttgcacaaagactccctagggttggctttctatggccagaagcatttatcctttcccatctctcaaacatgcaccctattccccactgcttctctttttcaaaactccagttacaaaagttcttttggcataaacgttagatgtacttctttaaaactgctggcagcagcattgttttcagaaaaagagactgactcctgttagtcatggtgagatgaagttgttcttctctttccctgagactaggaaagcagctctccctcacttttaatcttccaagttttctatgtcactaaagcaccatcatacaatctgattgggtctagttctatattttcttaatactaatgttgtctttaatattgattggtgaggaatatgttggwactctagacatcagtgatcctctaggggagtcttgctgcagagtttgtcttatataagcaattccacctaacacagtcaacagttagccatatctagggatatatctagggatagaccatatatgtaacatattcatttcctcattcattcattcattcaagtaatattgtaggattagatatacaggacacacaggacaaatcagactgcttctctcttagaatttatactctctttgatgagggggagagaaaataaacccagcaaacacagatgaaaagtaattacagacaatgacaaaggttatgaagaaacaaaacagggtgcggtgatggagaatgatggactgtgggagtaggacattgctaattagatttggtggtcagggatggcttcacagaaatagtaatctatgagccgaggacctgatatgacaagtgggatccaggcacagaaaagctgggaggttgccgtcatgacagaagaaactcaaaaggaagagccccacagaaaacaccacctgaatgtttgaagagaaggagggtatgctgggccatccattgactagatcttgtagggyttgaatctttgtaatcttggaggagaaacttggattttattcccatcagagtagttgaaaaaagatgaaggaaaaactggaaaaaattakaccactttgggatctatcttgaaggaaagctaacaagacttgttagatcaaggataggaagtgaaggaatgggtagaatcaaggataagtcccaggtttttggttcaaacatgtaggcaaattatgaactatttgctgagatgaagaaaactgagattcgaggaattaaaattaatttttttgatctgttaagtttgatatattaggcatccagatgaataagctaaataggcaattggatgtaggaatctgaagctcgaatagtacaaaagacaggacctaattaacaaagcaaggacctatagtgtgatacatgtatgatgcttatttttcaagctactatttgtagtttgacatttaggctatataatttgtctatatatgtcaatgtagaacacccacattttgacattctcaaggcatagtctatacttattaggaatgcattttctaaaaattatatcccctttccttattttgttttcttaaaagctaagaaattccctgggagccagaaaacatccttatgattctgaatacttttggtaaagaatattgaaatttgacaaaatgtcttacacttgactcccattataaaaagagaggtgttttaaagtatcagtgtattcattaagtatttttattcatttttaaactttacaaattgtgttaaatttttcattagtaatgcttagacaatcctgcagtgagcccctaagagtttacaggtttttttttattattttgttttgtttttctgaggctgacaagatgaaaattttggaacacaagaagtgatttatggcagtgtgagagtgtttaagagttcaattagaaaggaaacctgctttcttttctccaaaagaatgtatcattcctttcaagagttttctttgtcatatctagatatgatatggaaatgaagaagattcagtagtgccagagaataaaattccaataaggagagatcraatgatgctatcttgatcttsgtatcttgaacttgtttgtttgttcatttgtttcgccagttactttttgaatgggaccaaagacrgtcataagctaaaatcttggctttactttgtacctggttaagtgcattctatttattcttttttctttattgaaaatgggcatattaaaaatattctctcatcacattttcatgttcttagtttctacataacttcaagtgttttatcatgttttctccttttcatgtcctttaaaagatgtaatcaatcaaagtacatagttttggaaaacttttcccaccacattttagtaactttttaaaaatagcattttaaaattaatgtaaactttaattgttatcaagatattctgatatagtttcattacaattctctgtagctttcaaaacaattgattttgcctgtaagatctagttaaagacatttatatattttttattatttgtattcctcaaatatttgaagcatattatatggttgagaaagtaatctctctttcaaaacccagttttccttaaataagtcaaagatatgtttacattgttataatagatataaaagcatttagagaagttggtaagctgccagaaactcttttcagcttagaaactgtaaatgtagaaatacaaggggctaacataaatagctgttagcagcctgaatgctagtggaattacacaggaatttgtgaatattttggagtgttttagaactatgtgtatatattaaaggctttttataagtgctaattttaatagttaatgattcacatttcataggtagcagtgcatgtaaaatatacacatctttttctatctgtcctttatgccatttatgctaattccattgaggatacatatatcccgtctttgtaaaatttcccaagaaatttagctttatgtaggaaaccatctgatagtgcattggctacggaatctaatgacataggcttaatttcaagctcctgttgtttgactttcagttgctcacttctttaagccataattcttctctttatataaaataagtaacaatacctacttcttctaattggcccttgattctcataatccagttatgagatatatgtgaaaaactgtaaacaaggaagccgaatacaaatggaaggattttaaacaaaatgtaggttgaatgcagtgactcatgcctgtaatcccagcactttgggaaaccaaggcacgaggattgcttgaggccagaaatttgagatcaatttaggcaacatagtgacagtcccatctctacaaaaaaaaaaaaaaaaaaaaattagccaggggtggtgatgtatgccattagtagtccatgctatgggggaggctgaggtggcaggatcatttgcacccaggagtttgaagctgcagtgagctatgatttcaccactgccctccaacagcttgggtgacagagcaagaccttgtttcaaaataaaaaaagtaatattttacatgaatgtatttataaaattagagtaattttgtagaatgtatttataaaattagagtaattttgtagaatgtatttataaaattagagtaattttgtaggtattgaaaactaattggtctttgactaataaaaattacataatactgattgtaaaattccatataaatagatcatgatcattttaaaataaaactttaataataaaatattaacaattttatagtggcttgtcacaaaaagactaaaaataaaaaaccagaaaccctaaaaatattatgcatatctcctcttagattatgtattcttattgtagatgtggtgtgttagtaagattttcccacatttgatattaatttaacatttaaaaacttatgtccaggattatttctttgagtattcatttgctatttttcacattgactattccttaaattttctattcctgaacttccttgctatgaacacataaagtgaaggtcagaaatggttaatctttgttctgcagtgagggcttatcaggaaatacaagaatattcaacaaatgataaactattagaattctccatgatcacatcatttttattcccagcgggggtaaaacacaatgaattaagatcaaggatttaatgacaacttttctattaatttaccatgtgacatagggcaattcattgaattaatttatttgccccttggagttggggagcctgaaatttaagcctaaccaacaaccatgtcttatgagctttgtgatcttgggctagttcttgttctttcatctatataatgaatgtaataacaattatatccagaggtgataggatgattaatgagttaactcaagtagaaacaggttgactagaacacggggtgctctctggaagaagcttcacaagatttttttattatcatattgaatatgccaaaactgaagatgtagtcttcagccttccaggaccagaactcaatttatcagtacatgtctttaggttggactcatataaaccaggctcaagaatgccagtttatggcttcaaagtctcttcattgctggaccttccctgatcttcttgactaaatgttggcatgcccctgactcactctcaaacctttactctttacgctatattgtcactccatggataggctcctggttgcaaataccgtctacaacttaactctcaaattggtgtctccaatcctgtcttctcccttgatttctagttttttatatctagattcctacctgacatgtccacttagaaatctgacatcttacctcaaaaatagccaaagtccaactttttacaccccgctagtttattccttgtttactccagcctatctgcctccttgcctttccttcagtacaccaggactttcctcccttggactgttccccccctggatattgtatagctcactccctaacccatcaaatacctcctcagagtgggcttctctgacctcaagctccactaatgtctgttgtgttcacactaccaacttgatgggctccctacccaaagtttgggtagactgatgttatacatgcatcaagagaatacaaaaaggttaactactgacagacccttctgaggagagaagcaaagagttccaagcatgtccaaaaatggctggagagcaggggaaaagactggttcaacttttatttgataaaggagcatcactagggtgaaagttcctgggcatttaggcctgtatatgttgatctgaacatacagctggtgcccaaagaaagagcactgggcattctcatcagcttgctgaagaggaaaggatagtggtgcggtgtgaaagctgtgagcagtcacgcatgaagaatggagatggacactggattatgaggtctgtcttcttcatgaaagtgtcttctttcactgctttatgtttcttcctagagcttataattccattacatattttatatataacctctttctttatctctcttaatcttcttccctccactattgcataagttccattaygtattattatatccttagtgcctagaatggtgcctgacacatagtagatcctcaayaaaatttgttaatatttaaacaaaagagagtagcaaatagaacaagtccagttgctgggatacttgtgtgctcatgaccaacataatctttccctagtctcagacctgcaaggaaagctaaattctacagaamgttggtgtttctggaggggacaaartccaacaagggaatttggataaatcaaagtttctatcgttgcaggcagggagttgggactctgrtgcattcaggtcactgcagaaatgaccttgctaatgggaccctgcactttttggaacgtttcattaatgagcgctagtagttgtagctcaggtgacagtttttctgagtttctaggaaaaatcaacctcccttcacatctacgcatccttttcttaggtgatttaacacagttattcaagttagagccaagtcttgcagaccgttggagctagtctttctctacaaggtgcctttgaatgttctgggtctgaggcatttgctttccctccactgttctcccacgtgctgcaggatagaaagcagctattcagagtaagtagtctgtaagtagcagttcctatccctgtactattatgtctggaaaatgagtttgaagtaagccgactttgtgctgtaacacttgaaatcacagaagtcttttcaaactatcttttgtgccttaaaatctttgttaaactgatggctgtcatctctgaaaccacggcccacccaaactcaggcttgagttaaagscaacattgaaaagattttcaggggcagctggaacctgtgctgtcttgaccttgtaggccactcattttaaatactaccaaatcctttcttaaaagaagtgcatactctctccccacaccactcctttcctgcttcagtaaaagaaaatctgttcttctgccccagtttatgcctatttttctgccccagttctccgacatcctgttcgcatttagtgttacttcttactggctctgcaatagccatttgacttggtgtctatattgtttcagtgtataatattggagtgtctgtgaagaaagcaaactgttggaatgttttatctttcttattattacataaggtgtgttggtgtgacacatgtatatatataattgtgagcaggttttaggaaaaagaagtcttataatccctaacatatgtttatattttaggtgatcttttaggagttagatcatgcttttatgcattaaatggttagttatctaaagctgaaggcagaaatgatttgcttctttgttttcatgatgaatttgtttcttttgtgtctctccacctatcaacaaacattcttttgtttcatgaaaaattaaggttgatataaaattacctgtatttaaacagagcttgagaggttcacttttcttaggcatataaagaggttattcagcctgagtatgttagagattctctaagtaggaataaccacatgttttggaagaaagaggctttgtttttagaaaggcattgttagaggcctgagtatttcgggaaatgaataaataaattcttgaccttgtaggaggtacctacagttcaacttactgtgcagcagctcagcagacactgctgggaaaacatctctcaaataaccttttgaagaaaccagagttttggttcaagttgatgtgactactttattggtatcatcacatcaatttgatgaatggtcctgaaagctagagggaaatatctattgaaatccaagaccttgggatgtctgtattaaaagctctgggccactaagcaagttctcttaaattttaaaaggaattttaagtagttaacgatgaaatgagcattttctacatgtttgaatgtggcttactcaatgtgtgtatgcaaacatataagcatctgacaaataaaactgaaatattccagtactttttcagcttcattgagtaaagaacaaaaccactgaattagaaactcatgttttgatgacttcctattactgaaaccatgggaacaggatcggtaaatagagcatgggcttttgaggctttgtaaagctggtttcctccccactccctccattgttccctctcttgttccttccctctcttgttccttccctctcttgttccttccctctctcgttccttccctctctcgttccctsgttccctccctctctcccaccctccctcactccctcccttcctttcttccttcgttccttcgttccttccttccataaatgtgttgtgaacacttcttatgcaccaggtcctattgcaggccatgctctaggtaatgaggtacagcagaggacagagcagacaacaatccctgcctttatagagcttacattttaatgagttcaaattatctctgtatcttatgtgaacttggatctgaacttcatttctccatatgcaaaatgagaataattcttcttcttttatagggttattgtggtgattaacatgagacaatacaatactttgatatgggggctcaagcatgttctctctttgtttcgcctgacctggcagcccacatgggttttgctgctgtcctgcattctctgtatttgtcctctttcttgctgtttctctactttggtttttgagtgtatctgtgggtctcagtgcctttatttctatgtgcacccgagtcttcttatttgtgtgctttggcatgtgtgtctctctcactgtgtctttctttttatatgcctctgtatgtctagtttgtgtctttcttttttgatctgtgtgtgtgcgtgtgcctgtgcacgagagagagagagagcaagagagaatctgtgtgcatacatctctgtctctgcatttttctctcttacagtgtgggtttctctctgtctctgtgaatttgtctaagttttaaaatcaaagttctgtgaaaaggaatttgaaagaaagcaactttattccsgtgaactgtttgcaaactgtaagatacagcctttgctgtgaaacttaggtacattccagagaacaaagggaaggttgagtgtttatagcaacagttcctgctcaggtttccaatcaggtccatttatgcaaatgaaagactcaaacttgctgagttttgattggttgatgtagctgagttctgcttgatcaattcaagccacagcttattggttggttcaggaaaaatgaacaagaagagtcagctatgaaagccttagcartaggccagtgcagtagctcatgccgataatcccagcactttgggagtttaaggtgggaggatcacttgagctcaggagttcaagaccagcctgggcaatatagtgaggccctgtctctacaaaagtaaaaaattaggtaggcgtggtgacacatgtctgtagtcccagttacttgggaggctgaggcaggaggattgcttgagcccaggggttsaagaccagcctatgcaacatagtgagacctcatctctacaaaagtaaaaaattagctaggtgtggtggtgcatgcctgtagtctcagctacttgggaaggtgaggtgggaggattgcttgagcatgagaggttgaggctgcagtgagctgagattgycccactgtactccagcctgggtgacacagtgagaccctgtctcaaaaaaaaaaaaaaaaaaaaagaacctcaaactcaaagttaagcagatgtgtgtgagctttctgagaactcagagaacgtgtctgacctctagtcaaaaaacagctcattggctctattttatgtttaggcccagttagccactcaggatttatcttgaggaattgtctcattcaggttcatatttggatcggtacatgaatgtgtgtgagtgtctctctatgttcctctcacagtgtgagtccctctgtctctgtgtgtgtcttactgtgtttaggtttctataatgtcagtttgactctgtctttttttctgttttgttcattcatattcttgctcttgcctgccctttctccccttgctccctagctctgactctgtctggctctgtctctcacctttttctcttgttctgtgagtctctcttgctttctttctctctgagtctctcactttcactctctgtctttcctgcttttcgtcagtctttcacgctctctctgtctctttgtcacttcatatctttcacttgtgtgagtgtgtaggtaggtttttgtgtattcatttatttaattgtgctcattatgtttatgcatgtcctctcattcctatcccaatatagcttagatattcggtgatatttaggtagcaatctcatatctcaagaagaataaaaaggaatagagatttattctaaagaagccataaggggatttatggattgagaagtggagttttaaaaattacagatggatattaccaagatttggttgtatcttaggtgacgtaccactaatttcacagtatctcaaaactgtccagtataaaaccaaatataattaacaaccatcaggccctcatctctatgtctagatagtccagggtcactttttaaagctctctttgctgatcttgatgatttttcttcttcaatggttgtcattctgttgagcctgctattctatttccttgactacaatctaggttctcatcatcatcacccacatcatcttttgcctgaactacttcaggtgctatccctggccccgctaactttccatccatcatgccaggtgggggcaggttattgttccatcatctttctctccttgatgccctccactggcttccagtyttcttccagggttcaccaatagagtttcacaacataaacagctgtttttttttaaaggctcacctgaccaatattttgcccacctaccactatgcccaatgtgtataggaagccatgcttttgaatgctctgactaggcgattttctccactacaaatattaactcccagttatttctaatgggataaagccctttcctgagaaggaaacataaaaggaaaacacatgggaatctggataaggaaactttataaaccaatatttgtagcaccaatgtattgtccagttaaccagacgatgcttaacttgttttaatactaagaagtttttgctattttgactttgtatcatttaggaaagggttcagcaagatttttctgtaaagcaccaaccaagttagtaaatattttaagctttgtgggttatactgtctttctgacaactatttaattccacccatgtttctcaaaagcagccatagatgatccataaataggtctggttgtattttttttttttttttttttgcgagacagagtctcgctctgtcgctcaggctggagtgcagtggcctgatctcggctcactgcaagctccgcctcctgggttcacgccattctcctgcctcagcctcccgagtagctgggactacaggcgcctgccaccatgcctggctaatttttcctatttttagtggagacggggtttcacggtgttagccaggatggtctcgatctcctgacctcgtgatccgcctgcctcggccccccaaagtgctaggattacaggcgtgagccaccgtggccggcctaggtctggttttgttttaataaaacattatttgcaaaaacgggacatggctcagattgggcccctgcaggctgtagtttgccaatacctaatttagactttatgataatatcttattatgtattccatataggtaaaattttcattcctgtgcacactgtttttttttttttttttgagacggagtctcgctgtgttgcccagactggagtgcagttgtgtgatcttggctcactgcaagctccacctcctccgttcacgccattctcccgcctcagcctcccgagtagctggcactacaggcgccagccgccgcgccagctgccgtgcccgcctaattttttgtatttttagtagagacggggtttcaccgtgttagccaggatggtctcgatctcctgacctcgtgatctgcccgcctcggtctcccaaagtgctgggattacaggcatgagccaccgcgcccagccactcgttttttaaagctttttttctctctcacctttcatatatgtatatatgcatgagtgtgtgtgtgtgtgtgtgtgtgtgtgtgtgtgttgtgtgtctgtgtgtgagtgccaaaaatataacttttgggctttctacagggtttcatataatttgtcattattataataaataaaggaatcatattattttcatttacataaaattccatgctcataatttgaatcaagaaaaccaaaacctgaaacatgttactggtaactttcaagaaatatctcaataatctgtaaaataacaacagtaatttatatcacgtattttatgtaaatgatgtcatttatgtttaactcttttgtaagtgtcatgtttagattcttagttaccatttaaaacaagattttagagaattgttttaaagtattttgtgtatgtgtgcttactgaatcagcttaaagatgtttgtaaaattttagacttttattaattgaagaccttttatttgtaaatcttatctaaagtgcagttgaatagatttaaaattaaactttcatgaaatctgaattgaccatcattatgtacagcaaaaaatattatatccttgtcataaagttaattctagataaatgtaataggtaaatgtaaagagataagaagaaaataatatatagatttttttgcttataggatgggaaagaaaattttaaatcacatattaatttgaaatattaataagagcagagaatgatccatttaattattaaaaacattgaatgtggctgggcacaatccacctgtaatcccagcactttgggaggccgaggcgggtggatcacaaggtcaggagttcaggaccagcctggccaagatggtgaaaccccatctctactaaaaatacaaaaattagccaggtgtggtggcacgtacctgtaatctcagctacttgggaggctggagcagataattgcttaaacccgggaggcggaggttgcagtgagctgagatcatgccactgcactccagcctgggcgacagagcgagactcagtcttaaaaaaaaaaaaaaaaaaaaaaataatgttaaaaataaaaatcaaattaaaagaaacaaatgctcgtaactattttaaaaagtgttaatcttcttaatacactattaaatgacaagcattcaacttggttaaaaataaaaagaaattaaacacaatatattttcttatcaaattgtcattttaaattaaatgaaatgtcatatttctaagaattcttcattgaagaggtctccatctccctctcctcaataagatataaatttttagccaacaatttggtaacatatccataaaaatatttacaactattggcttcttccagggatctgtcctaatgagatgcaaaaatttatagataagatattcactctactatctataatgatgaacatttaagaacaatgtagcagttcaaaaacaggtgatgaaggggtaaattgtggtataattatatgataatcaaaagcatggaacatcatatatttgaatgataacaatttggaataatgtccagaatttattaataaattagaatatatggccatattatggtgattataacttttaatgtatatatagatatgttacataatatttatatagtgagattatatattatttcattttttatttttctgtattctctaaatgttgtatgatatgatatgtgtatatttcaacatcaaaagaaatacacattttcttttcccacataacactaaacaatagatcaattgatgtttcctcatacctttcaaagcatggtcttctgggttttctttaaaggaaagaaaaattttttaaaaagagatcttggacattagagaaatgaatttgatattttgggacaaaagtcttgatcctagtttagaaaatgtgattctctgtatcaactgaatttcttaggatgattgtttttatttagtaagcttgtatagctatagcccacacaagttaaagcctgtggaatttggtttataaaccaccttcatattggatttcagagaatgccaaggcatcttataaatgatgatacttgctaaaactcatctcatacctgaaaagcttccaagcattataccatataaaagattgttctctattcaagcaaaataagtcctaagatttgcaatgctgctgtttgacgcaggaaaatggcagtggaaaatccaagagctagttccatgccaggcaggcaaaatctgccatgcccataggaggcgggaactagaacagaactgctgtgggttatatttactgtgagaaaagaaccctctgtcttgaaaggagctgcagatggagtcttttctccatttgcagaataattaccttaaacctcatttatgtaggtctaaggaaatcaacaagtgagagcgtttcacataattccacatcttggctatcttattattttcaattgattttttttttttttttttttgagatagagtccctctgttacccaggctggagtgcagtggtgcaatcttggctcgttgcaacctcctcctcccgggttcaagcaattctcctgactcagcctcctgagtagctgggactacaggtacccactaccacgcccaactaatttttgtatttttagtggaggcagggtttctccatattggccaggctggtctcatactcctgacctcaggtcatccgcctgccttggcctcccaaagtgctgaggtgtgagccaccatgcccagcctcaaytgaatttttaaaaatcaaaacagtacttttacacagttataaaaatgaaatagtactcttaggataagaaatatctctgcattatcagtacttgatctctagaagtaagcatctttaattcttctaggacatttttagttattacttatctccatatttctcagtaaaatatgtattctactatttcttgatttttcagttttaactgtcgtctacctggcttcctactcacatactcactatccacacacatatcttctctctctgtgacaccaataaaattatgatagtttaaaaatatgtttataaccagtttttaaagtattgtaaagaagtgacaatatataaattttattcatagctgagacatactgtatttatttcattacaacttttctcttttcattccttataaataataattgtcccatttttatattttaaatttagctttctaatgtctatcacaaatccatctcaaactccccatcatagctaacatttctttgtgtgtgtgtgtgtgtgtgtgtgcctgtgtcactctgttgccccggctggagtgcagtggcgcgatctcggctcactgcaacctccaccccctgggttcaagcaattctcctgcctcagcctcctgagtagctgggactacaggtgcacgctgccatgcctggctaattttttgtattttttagtagagatggggtttcaccttgttgcccaggctggtctctaattcctgatctcaggcaatccacccgcctcagcctcccaaagtactgggattacaggcatgagccactgcacctggcgctaacatttcttaataagatttaataacatgttacgtgtttttaataaatcgtattttttaaaggcgtccctgctaacgtgctgaatcagtgagtcactgtcctcccaaatgtgaacaagattctgatttctcycagtataaattagttttgcttgtttcccaaaaacagaatctaaatgaaattatatatatgcattcttttgaccttgcttctttgactcagtcagcactatgtcaatgagattcatctttgttttgaggtatagcagtagttcattctctctcatcactttagagttatggtaggcaaaaaaaatacaaattacaaattaaaaattaaaaaatggccccttcaaatatgtccatgccctaattcctggaatgcgtgaatatgtgtgcagtagaaacattggcaaaagggattttgcagatgtgattacagttacagagcttaaaataggaagattatcctggtggatacaatataatcgtatcagactttaaagcagatgattttctctggctgcaagcaaggaagactcagcataggggaagttggagatttggaaaatgacaggaactcaatgtgtcatttgttgttctcatatatagaggcctatgtggaagaactggagagaggcctctatgatctaagagcagcccccagctgatagccagcaaagaaaagagagtcttagtcctacaccctccagaaacttgattctgtcaagaacctgcatgagcttggaagcagatacttccaagagtctcagtcctacaccctccagaaacttgattctgtcaagaacctgcatgagcttggaaggagatacttccaagagtctcccaataagaccctagccagtcaacactttcatttcagttttgtgagtcctgaatcacacaaaccagttaagttgatgtggacttttgacctacggacactgtgagatagtaacttgacattgtttgaagggcctaggtttatggaaatttgtatggcagcaatagaaaactaatagaagactattccattatgttactataacacaacatttaaaatatatctattttactattgatggatttggattgctttcaattgagacttaatatgattaatgatgctaggaacattcttatatgtgtcttttggcagatttatgtatttatcttggtagataattaggagtggaatgggtaggttgtattttatgcatatttcagcattagtagatattgctaatcaaagtggcagcagtaataggcactcctgcccatggtctatgacagtcccatttgttccatgtccttgccaacacttgttggaaaatttatagtgctatgctaaagaagaaatcataatgtttgtaaatgtttgttgctacttcatggtgttttgatttgtagttctctgatgatgaatgatgttgagcatattctcatatacttactggatgcttggaggtattctttgagaagtacctgctcaacactttgtcagtcattcaagcagtccataagcaacaccatagctgcttgactggctcaccatatttccataaaactggttagtaaggaaagaatgaacttaaatagatttatgcagcacaaaaagcatcataaccttctgttcacatctcatgtccacaacagttccctctccccacacatcctatggggaatgcagaggtgggcctaggtggatgctacatctgtagcataggtctgtgcctcagctgagaacacggcccttaggagcttcccagtcatttaaggggctactgataaacctgccctttctttatatctgagaaagagttaataaagatatgcaagtaaatcttcttgtatgtaaacaaattttctcccggaagaggagggagactttactatcatggaaggtaaataaattttctctgtgacccaaaaaccatctctagcttccaagcctgtttgccacacaaatacccttgaaaagatacatatagatatagatatatctatatatggttacataaatatacatatattatagtttggtgtaagtatatgcacatacatacgtgtattatataaatatatatcaaactatttatacatatatacttttataatataaaaatacgtatttttactgtattgcttttgctgcatagcataatttttattctgtcttatttttcttatacagttcaaaatactttttaaattttcattgtaatttttttttcttttacccatgggttgtttaaaggtgtattattattatgcaaacatttggagattttctagttttcttttttgtaattgatctgtggtttaattttattgtggtcagagaacatagtttgaatgaagcttaatgctttgaatttggcttagacttgctgtaagactcaacaaatgatcgatctattttgataaatgtttcatggccacttgaaaaaaaatgtgtactcttcagtaccttgttacactgttctgtatacataaattaggtcaagttggttagttttctttaaacttccatgttcttatgatttttttcccgcttattctatcagtaccagagagagaagttaaaaatatctcagtctattttagctctgtccatttttgctttatatatttgactatgttgttaggtaaatagaaatttaaggttgctatccatacagtgaattgacccctttattattattaactatccctctttatctccagaaatgttgctttacttaaggtctactttgtctgatattagtatagttatactagcttcctcttgggtgatgattgtatrgcttacctttttccatccaactactttcaattttgggcttatgtaatatttaagatgtatttttcataaacaggatatagttgagttttatatttttatgcattctaaaagtttttttttccatgattacatatttagtccatttacattttatgtacttatgatatatttgcttttatagcttctatcttgctattttttcttgttgtctcatctgttatttgttccctttcccccttaatcttcttttgaaataatatttttattattagttttcagtgattagccctttagttatacatccttttatatttgttttatttatttaagtatttttctttgagtaattacctggaaggatacaagattaattcttaacttaccacattctatcttcaaatagcatattttccacttctttataatgcaagaactttgtaacacttctcttttctggtcctcttcattccttcctgctttttgtttctttgctcctgtataatattgttttctttggtgctaagaactgcctttagtgttccatctgtaccgttctactaaaaacaaaattttccatttttatttgtgtgaaaacatgtttttcctttagttttgaataattctttagctgagtatagaatgctaggttgacaattattttcttgtactagctttaaaatattatattgtcttccaggcttacggtcattgttgaaatrtcagccataaatattcatgttgcccctttggaaatgatgtttctatttctttctggctgcttttaaaattctccctctctttttaatttttatatattttttcttcttagcaattttgccagaaaatgtccaactgtatttccctgctatttaacctgtctgaggttttaggttttatttatttattttttcatggcttcatgtctttctatcacttttggaaaattctcagttaaaatctcttcagaattgcctcttctccattcattttattattctatagggctccacttgtaggtatttttggcatgttctttgcgtctcatatgtcttttacttccttttacatatttttattctttaaaaaattaattctttaatcatcatatttcagaatgaggcactaaatgcctgatggcacatggctgggatttgtcaacaaaaggctcagattctagggtgactaagtgaggatccagacattttattgagatacttccagaagtcagtatcttttctcttggactgaccagtttccttgatagtaactgaacagtttcctgctctggtatatgatttggggtatcggaattctgatactagagcaggaaaagagtttagtgatctcatcttttagtatgtagactttcatttaaccctcctgttttcagtagtgttaacttgaaataaaaattacataatagagatgcatctctaagcaaagagcttatttggaaacaaaaaattgcaattcgggacacatagaccagcgtagcctctaggtgtgtctgaagaacaaaaggaaaggctggggttttattgggaaaatgaacaaagttatgtaagctgttttgaaggaagtttcattggtgatggcagtgtcttatgggagctggcgagttctgagtgtcaacagttaccaggtaagacttaaagttatggttaggtctttgtgcttttgtgtttgaattacaaaaacattttctggaacaggtatgcatgacctgggtgcctttcttcatggcctccaaatccattttagtttggtatgacgtgaaggactctattttgtaaaattaattttcacagtaagttcctcaacccaaactggtgtctgtctggctagacatctccagagattactttccagtctttggccaatgtgtaggaagggcaaactcccagatgctttgtctgtatgtagatattcagttatacaactgcttctgaaacaaatttcctgccaagctttctgctttcctcattctttttgatgcttgcttgacactttcaggaacccttgtcgagtgctaacctgcaggcttggatttcagccttatccattctgctcaatcacatgtccttttatctcttcacttttcagtttccaaaattacctctcaactcacttctctctattcttgagaattcgtagattaaaatcttcactttaaaaccatttaaatggtgtttagagaaactgaaataaataatgtgatccattaatcattttaaattatgggtaccaaagaagccagtttctctattttattgttgttgctgatttattattacatcttgttattttgcattttttggtgatgatggaggtaatcagagcaaataatggatttattgtgactacactgataatatatttttactctaattttaggtgagtgtaaaagttcatgttagttaaaacattacttactagatatagaacaaaatagaatcctgtatcttcctttaattctaaaatatgaatgaaaagtaaaactgtgagaatattgcacattctaaaacaataattacatatagttgccataatatttacaagtcaaatattactttgattctatggcctcaaattgtcgtttactctatgttaagcactgcgtattaactatacactacagtatataaggaagatgggtattattatcttttttaaaatagatgaataaactgagaatcagaggtaggagtcaacatcttgttcagaattgtatagctaattactgctaagcctggacatccaaacttaagtatgtttcatgttatcaaagtaatgatttttttcttcctgaaaaatgctttcttccttacctgacatttacccaaaaaaaaagcctttagtgatctgcaatttagratgagctgttcccagatatggaaaaacacaaactgtattattcttgaccagtgttactttcattaggatttggacacagttctgcaatagacttatacacatattttaacttcccttctgttattgcacatatgcagtttacgtctatgatatttttcatttaaataataataaagaaagaattagaaactggaactaattacaagtaaaacattttcttctaacagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaagtaagtacagcattttccttattaaagaaatacatcggtgcggtggctcatacctgtaatcccaacactttgggacgccgaggtgggcagatcatgaggtcaggagatcgagaccatcctggccaacacagtgaaaccctgtctctactaaaaatacaaaaacaaaattagacgggtgtagtggcggacacctgtagtcccaactagttgggaggctgaggcaggagaatggcatgaacccaggaggtggagcttgcagtgagcagagattgcgccactgtactccagcctgggcgacagagcgagactctgtctcaaaaaaaaaaaaaaraaaaaaaaggagcaccttgtggtctgccagcactcttctagatactatgcttgtaaattgtggtaaatattatcacctttttttttttttaagttgagaatttctagaaatagagtagtggcctcagtgtgagagacagtgctataggttatgtgaacctcagttatcttctgtattttctctctcatatcaccataatgatgccttttcttgttctgtttccaaatttaatgatataatttataaatagcaagcataggccctgatatatattgactctttccgtatatattaatttgactctttccattttccttgagtgtttttattccactatttctatttatctttcatcgtttataccactcaattctatacaggcttttaataatttttaaactatattaagatagcactaaaatcttaaaagtagccaaataaaccaactttttaggaggagaagattgacagctgatttctcagtagcaaccacaaaacacaaaagacagtagacatttaccttccactggcttggaaaaaataactgtcaaactggaacttatactcaacaataattttttaagaatgcaggcaaaaataaagatagcagtctcaacctttgtaaagcaaaactggtatagctgcaagagaaaataaatcttcagtaaccttctataataagaaaccactaatcgacatatgaaagaccctgcatctaactactgctgtatatctattttattcaagcacttttgaaacgtttacaaaagttactgkgccagttaggtaattccaacaaatttcaaaggattgaatatatataaattatgctctctgaaaacagtttaattgttggtagaaataatttttttaaaagacaactagataacctcctatatatttggaaataaaacatttctaaatatccattcatcaaagaaaaaatcataatagaaattagaagatactatgagctaaatcataaagaaaatgttacattaaaaaacttgtgccttagccaagaatagctgaaaattggatggagctcagtaactatctctataagttaatttttaaaaggacaactaaaataaactcaaaggaaataaaaggaaggaaataataaagagcagaaattaatgacatagaaaaaatgtttggtgatgaatacaaaaataaatagaaatataatttttaaaaagtaaatcgattctgattgatagaaggcacaaataatatcaggaatggaaaagggaacattgctgctgatactttagacattaagacagtaaaagaggatatgttgaataagttcatatcaataaacttgaaattattagatgaattggataaatttctagaaatgtacaacttactagtattgactcaagaattattttatcacactaaatgaaataaattcatactccaacatcttcccttaatttcagatagctttcccactcaggataatgaatattcaaagagcaaataattcctctgttacgaactcttccagataatgcagaaggagaaaaaacttcccaactcattttttgactccaaacctgacgtaatagtgcaagaacgaaagtacttcctacagacatacatgtatgaggaaagcttttggttgataatctctctcctcaggtgtgtttccttagtggcctcacctgttctctgaaagtagcactatcctatagcattgyttttgacatttccagagcaccctactcaagccatatttagaactgcttttgaagagatctttaagaatcccataatgcgaactttggtgcttttttgtcactttcatccctaactgctttagttttttaggtgaaattttctgtataataaactgccatacctcaaagaacacctggaagcaacaaagtatttgcttttctaatccatggtgatttttttcagtatctggaagtaatcggcagacatgtgtttttcatgccacagcagctcactttttcagtctagttgcccattcaaagctggtgtaaatcacagtaatgctctaaaccaaaagaaggtgcaaactatttttataatgcattcttttagaactttgagggtatagttgacatctaagaaatgcactttattctgaacgaaagcattttggggaaagtaagtgctgattttactgagttttacgttccttgcagttaattttctcagttaattgcactggttccattacaaatttggtattgatattgagcccctttgtgaagctgagccattctaaagcaaccaacaagggtatgatgatttgtattttatattactgactttattataattttctaatgctttaaattttctgtcaactgtaataacgtcaatcatataaaaagtcatgattgtcttcaatttatttggaaaacctctgattttcaactcattttagttttctttttcagtttggaaatgaaaaaacaaagttgtgcctaatactttatgacttctagtctgtcttttatcattttattcacatgttgttttgttagatagcaggtaattagaaaaatttggttcaatgattatctcataattaagagaggagatttgataaatgtctgtcaaaaatgctaacctaatggaggctcatgcttattatctgggagggaagcagcctccagagataaaatgttacaagtgaaggagaaagataaggcagcaacacagagttcctataacccattgtctttatgtgctacacttactattttaatgcataaaactgaagagatattgtcccacatattctcccagggcaaactatataaaaaatttagtgacaacatatttgagagacaaactcaagtagaattatgaagtgctttctctttttctgtagtattttcacctggggaaagtaactaggaagagacaaacataaaatacatagataaagcttgaaaaaagggagaaaatgaatctaaataaaaggcagctgaaaaaaatgaatgcacattttatacataggtgaaataaagctcggaaaaaaaaagagaaaatgaatctaaatgaaaggcagctggaaaaaaaaatgaatgcacatcaaaatagtaagttccccaaaacgaccaggaaatgtttagaaaaacaattactcacaggcttgaaaacttgcaataatattctctttaaaaataagagcccagaaaagaaaaaggatcaaggagaaacataaataaacaaaatgaactaaaaagtaagcacgctcagctcaaagaaaaaaatagaggaaaaaatgtaaatattacacaaatgagcatcacataaaataaaaggaatgtaaacgttgttagggagaaagatgagtggaattaaggagtcccacaaacacaataaaaagagcaagcaaatgataatttaaaaattaagaaaaaggattttgaaaacatagacaatgatctgatgtgtccttaattggtgttcctgcagtaaagaacagatcaaagaaaaaaataattatttctaccctaatagaggaaaatttccttaaggtaaaaacttgaatctttagcagaagagtacactatatggggtagaataattatcagaaaaatatatcctggtaaaattatgaaacaaaaagaaccaaaaggagattttgaggtagcaaaagcaaaggatgagcaaaatgtaacacagatgagggtgggaaacatctcaggcattctcaaaataaaacactcaaggctagaaaaaaaggaaagaattggcttcacttaagaatttttgttctggctaagttgcttctcaagtatcaagtcaacaaagaggttttctcaaagttttaagaaatcagaaactataatacctgcatatttataggaatgcaatatttctttgtaaaattcactgaatgaaaaatcatggccaacttgaagataaaccataacttagaaatgaaagaatcaccttcagttaaaatgcctgatggtgaacattggatcaattcacacgtagaagattgaacaactctgaattgtttatacatggaataaaacctgacaatgtaaaaataattataacactaacaaaaatgggagtgggggggaggaaaggaagaaatggttattctcctacctgtcatattggcaaatccatagataacaacagaatttaaaatttaccatctaaacttaaattttaaaataatatatgagattaataaaatggctcatttctttaaccattttcataagctgttttattgccttaaaagtaggtgtcttttagggatgaggaaagttagacaacttcaaaataagagaacagtccccacaagacsactcccatttctgacacaatttcaggagtcccaaagaccactctcaggtttgataatttgctaaaaggactcacaaaactcaacttattacagctaaaggatctagattataatcagcccagggatgtcatatgtaaggcagaatccaggagggtaccaagggtgaagcttccagttatgctgtgttgtggagtcagaacagcattactttcctggaattgtataataatacgcacgaactggtgccaaatggggacgctcataggaggcttgatgtccagtctttctgggggcttggttgtgtaattcgggttgactgctcacatagcttacttccatctcctgccccttgggaggtcaagctgggtgatccaaagcccccggcctacctcacattgttcatgtgcctcagagaccccatttctaaatcatagtgttaccatctagttgcccaaaggttttagacaaaaaaatgtactactctattaagaatgacattccaaggacttagagatcacctcccagaagccaggacctcttttgggggcaaggttaaattctttactacacagggactgatgataactctgttcccgactctactactatttcacttcgtgactttgacaagttacttttctctcagttcagagtttcctcatgtattaatcaaggaaattaactttgcgttccttttccaactcataaatttacaaatctgaatctgcaaagatacgtgggtgtggataaaatctcccagggccaatgcatagagccacataggtgtgtgtgcattgcacagttctgctatgaatgggaccccatgttttgaatgggaccccctgcagctgtgctccagacatgtacacatatacacatacataaacatgtacatttgggagattttaatgtgtggcatctattttttaaatttgtattataatgcagccatttttgtaatatcatgaggacctcttgaaggcaggaaggagaatggaaatatttccagttgagcattaatcctctgctccagagtacttctagaaaatgctgtgatatatttaattgcgtttgaattataaaattattcaatttctgactatcaagtcccctttttctgataacagacacagtaaacagtaatttgctgtggaatgaatctcacccacacacagttgcccaattaatctaaaagaaataacactaaagctgacatcacaagtcactgggcaaattttccaaaaaacaaagcatgttaaaacaggagagaaaagaataagtaatgaacagggctctgtttttgtttggccaagatgataaaggcagtcccggaacttctggactctttctttctactagccattaggcaagtggccaatatcctgttatcccaattacagacaaagaccaacaagatgcaagttcgtattttaataaacagtctttatatctagaataacaatatatttgctttgctgcctctttcattggctctaatcctaaaataggataatattaatttctacatcataggatgttttgatgattacattraatagaactcttaaacacttagcacagtgtccagcatatagttggtgcccaatcaatattaattgctctcatttatattttaattcaaataatgagttgtgattcaagttacatgcttattttcctaatgctaagaaccagaggtatttgtatttaatctttgatgataaataatactattgcatctatctcaatcatcttatcttttcccacttatttgttctatatttgttcatttctcttctcctgctttccccccattcatctttccttattattattttatctcacttcattttattacattcatgttagtttaccattttctaactgagcttgtttgattgctgagtagaacctcaattttcttacagaataaaaatgaggagggttgggcgaagtggctcacacctgtaagcccagctgcatggagggataaggtggtaggattgcttgagcctgggaggcagaggttgcagtgaaacaagttctcatcactgcactgtagcctgggtgacagagtgagacactgtctcaaaaacaaacaaaacaaaataggaggaggttggactaaaccagtctgcagttctcttccagggtgagaatttaggggacaaatgagcctgcatgatgtgataatatggacatgataggagcagagtagctgaagggatgagaggagacatccaatttttggttcttgatgcgatgggagttttctaataaatttatcatctcacaccaaaagagtgtggagaagcactgaatgttagtttaggagcgttacagtgaaaggctcaggggaaaggcttaggggaaaaggacaaagtggctgtcaagtaaacatactttttaggcatttgatgtgttttgacttttttttttagatactgtgaggaaaaaataacacaatttttgaattaatatgcttccattttagttctattaaaacttttcatttcaagggctattttaaataaatggctgcagaaaatggtccttttgcctgcagttaacagagtatataattgaatgcctggattgtttcagtatcttgattaaaattagtagtgttttgctaagtaaagtgtaccacaaaagaaatgaaagtaaatgccagtaaatgactgctgtttactaatacctttagttttgatttttaaatatttatttaatttgtcttcagtaaaagttgttttaataactccatattccaattatttatttcaattagcatagtctactacagtagactaaattgcttgcacaagtaactaaatgcacaagtaactaaatgcttgtttctatttgtttgatttttttttttgcagcttctttccacttttgacttaataaagtatgactttcagaaagatgaacccatgagaaatgagcagggttggtgtattcatgtgaaaaaaggtaagacttctatttgaagacatctcctcaagcaaagtttctgatctcctgtatacagacatcccttggtatccttgggggattggttccaggaccccgggtagacaccaaaattcatggatgtttgctccttatataaaatgatacagtatttgcctatgaggtgtgcacatcctcctgtatactttaaacaggttgcttataatacrtaatacaatgtaaatgctacataaatagggtcgtatggtattttttatttatattttttattgttttattattattttatcttttttaccaaatattttctatccaaggttggttgaatccacagatgtgaaaccatggatatggagggcccactgtgattattagtgaatttaaaaaggagaggatgactaggtccactgtataatttaactttggaattttaatgcaggtggaacaattttactattaaatgttaagagccctagagggatcactcagatggtaaattattaaaatacaaaagtggtaactatttggctcatactattcttaatccaccacttgtagtatgaacagtggcaaatttctaatgtcctatattgccaaactataatatagaaattagtgaattaatttatcactctagatataatgtaaagtcaggccaacttggatttaaacgtggtctctgacacttagaaatggtgcaactttagacagattactcaacctaagtcttattttcttcatatgtaaagtagaagtgacaatgtttattaagtgaggttattgtggacgattaaatgggatgtatatatattcctgggggacctggtatgtggcttgttactttcctctcctcagcttctccctctcactcccctcccttctctaccaaggtagactttcttacaattttaggttagaaattttcatgaaagcaagtacttcaattaacttgctgctgcatataatcaaattagaaaataaaatatagagatgtgcacttagaattgtttagagatccagtatggataaatcaagccaaaattaatttgtattgccttaaaatatgttgaaactgcatttcagaagtggcttcctaaatcttttcttcaaatgtgaagataaggtgacaaacctgtttttattttctggtagctgaaagactaaaataaaaaatgcaaactttgtctattaaaaaacaaatctcccaaatctctgaatttcaagcctactggcatttatcaaatatgtttctccaattctaatctgtagacactgcccatgggaaaataatttctgagcagagtgcaaagaacttaagtgcacttttctactgttctatttcttacaattatagtaatatctgatgttaaaacttgaatcccagaactgtgcttatgtaacctcagggtttcttaaaaagctggttgaccccaaatatctgtttttctattttggaattctcattatgagctactcaatattttttccattaaggcattgtgtcttcacaatgtaaattatgcccagacaggaaagatatgaatacactgtgacctatttaaacatttgcaacaattagtttgtcagaaaagaaactgtcacctgtgtcctaaaaaagaaaaaaaaacgtaagttttaagggagatataagagtcttgaaaaattctgaaatayagggaatgtagactgacagaatatatcacagaggtaaggctttggagtcagatgtacctggatatatatatatatatactccgactcctgcatttgacagctgtatgacattgggcaaattcctttttttacgcctcagttttttcaccttaaaatgaagatattatctgggcctttcttataggtttgtgatgagaattaaatggattacatatgtaaaacactcagaatcatgactattatgcaaaaagtgctcaataggtataattgtgatgataatgatggtgatgatgatgatatgatggtgttggtgatatgatgatatgatggtgatgatatgatgatgatgatgatgatgatgctatcagactgctggggcagagaagatttgctttggccagtgacctatgtgcccttgaaagccagaatgcccaggagtgggagaaatgggagtcgagtaaagactgttggctgggtgcggtggctcacgccagtaatcccaacacttttggaggctgaggtgggaggatggcttaagcccaagagttctagatcagctgggcaacctggtgagacctcgtgtctacaaaaaaattacaaaattagctgggcctagtggcatgcatctgcagcccagctacttgggaagttgaggtgggagratcggttgagtctgggaagtcaaggctgtggtggaccatgatcatgccacttcactccagcctgggtcacagagtgagagttattttttttaagagcattaaaaagacagaaatcactctgtatcatagtttgctggactccaacttcatctagccgcatgaacactgcatcactttacagcaggcatagcaagtggacaatagccttgaagacttccagagcagtgattgctgctgtcctttgtcctctcgtcttctcttagaagtagcttttaccttgcagattgctgagaaaaaccttaattaatttgaataagtttgattggaaaattatttcagataatgtgtctaaacataactgaaactaataagtatcatagaataggaaaccttttcaatgtctcatctctttcccatcaaaaatttccagaatagcatcccagaggaataaactgttttattataataacatgtgtgttggatcagagatagtattatacagaaaccttgccacacaaagtcataaaaacttaaatttgagttataggtccatttatttctctgagcgtggcaactattttacccctctcggtcctagttccttgctggtgaaatagggattatatcaaaggatttctatgcagaataagcaaagtggcatttgcaaagggctcatggtaaatgcccaataaaaaatgctatcattattttattaacactatcactacatttgttatttatataacaaatgtcaatattatctgtggtaacatctacataatccaaaacaaaaatagccgttggtctatccacctgggaagtataagaaatctaatgaggcttttctttccattcaattccctttttattagtttttccaaagtaatttgtatttgtggtaatctatgaaaggatgtgctggatataggcaccaagggtaaatgatgtcaaatacagaaataggttcagaggaagctgagataagcagcattggttgtgctggccagatataatatagatacattcatggtgtgtgtaacaatagttttaatcagatggctgcaaaaatgtcgttctttcttgcaggagarcctggacttctcatttctcgagtgaatgcaaaamatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcaggtatgaaatgttatgggatccatagcttgttctgtaattgtgaaccatgcttctatagaaacatcagagaccacatatgctttagctttcagggcagacagagcccttttatctccatgtctcctcattaaaacatttattggccatctgtttctagactgaaccacaagttaaattttgatgtaaagttttatgattattttagtgaatcagtttagaacaaatcagtgagctcctttttaaggaaataaaactggcagacagatgtaaaatataaatggtagggttaaaacagaaagccagtttggtcaactgtagtctaattcttggcctaatgataaaaattttgaagcagcaaaaatcccctttctcacatttccttttttaattccctaagattattttaggcctatgaaattattttgctttactagtccaatgacttgaatgaataagtaacttcctacatccttgccttcttgtaccatgttataagctcactttatataaaattatttcaattaaaacaaaatattcattcaaaagcattaaaggagtcaaagggggttaacacctagaaatttaagtgggtcagagtcaaaggggttaacacctagaaactgaagtgggtcagtgtcctaaaagacaactagagctttgctttcaattcttaacaccagagaaaaggaatgtttcacacttcattgttattttacaaaataatatttttgtaatgataatccttgtagttattttatttttatgtatattataaaacatagaaggtaatttatacaatgagatataaagtaattttgactaaaagaccaatgctgattttgttgaaataccaacaaagtgctttcttagaaatgcctttcatcttgaaaactacaattatgttggtcagtaggtgcttgcacagtgccaaatgcaagacattaaaactaaaactgggtacctagtttttcaaatacaggtgcactaactggaatttgatttttttcatttagatggaaaggagaaaatgtcgcaaccactgaggttgctgatgttattggaatgttggatttcatacaggaagcaaacgtctatggtgtggctatatcaggtataaatatatttcagattttggaaagattcttagaatagaattgccactattctctagttttgcaacagtcttgctaattcaacattttaatttttgtgtattaagataaagattttattattgtcttggcaagtaatgccccttgaccaagctaacaaagttcatgatcacatcaggggaaaggtaccaactgaattttaatgcctgcgtgtattttttttttttttttagcaaagcttgaaaactctgatcaatgtctcactgcttggaattagttacagctttttattagtctattatttttctttttatgactggtgtttgtacataccactaaacaagaacatgttctattttaaatgtttaaaaatactgacttttagttaagatggctctttataaaaattatttttaaatttggactcattatccttatagttatgcatatgaggattgtctcatgatgttgaaaatgccacagaaaagtgaccaatttgaagtcataagacagccattctccattttttctgcaaatgcttttaggtgcaggagagatcagggatgtgagtgtgtggataggagagcagaagaagggaatgattacttaataaatagccactgagtgttgaagaaagattccaggacattctgacccctgtaaagatccacaggtggcatgataagcattaaatgatttttggaatcaattatggaaatacgagtttctagtttcttaacttaaaaaataagcccttcatattttacattaaagcttaggatatgtatttctgctggaatatagttgcctttaaataaatgttttctttcttaatatttgttttagtgatggtaggatgcaaattcattgtaatttatagtgtttcccattccatgtatttcatttctgtagtataggcaattagagatagactctggccttccctgtccttaaatgatttctagggggtaaatcrtatgttcagggaaggatacagactagtttatgctcctgttgtcttattattactgaaatagatttaatgtctccatgtgtgccaattagcatgtacagaattatcttttaaagtttatttggtactyaaaaatgactctatttcaaactttttttcaggttatgaaggaagagcaggaatggcttctattattttaaaaccaaatacatctttagatttggaaaaagtttatgaacaagttgtaacatttctaccagcttatgcttgtccackatttttaagaattcaggtaattttagtggcggagtttactatcaaatataagacagtaaacaaggaagtagtttaattgcaaaataatattgtatcctttagatracatgtgagttatgtgagaggcgtggcgtgtagagttgatgcagatcgatgccatgtttgaagcctaattataaagggggcatggtgaaatgctaggacgtacctgtctttgtcctaattatagaattgctctcttcctcttcagtcaggacctcagagcaaaatgatggtcccagtgacggtggcaatccaaaaccacatcttacttttatcttgcgaagacatttggtgctatgtgcctagaattgggttccattaaggagacatcaaagagatggcaagatgtgtgcagaacctaaaggcatctggctttaggcaatcctgctttttaatttttattgctgttctgtccaaattccccctcacctggaccttccccatgtgagaaattctgagtttatttattttgagatgaggactttctcttgttagcttactggtataagtacagtaaaaagaaaacaaatttccttaactactgggtaactttacttactcatttattcaaccattcatgtatttaatattttgcctcaaatataatttcccaaaattattactcatcatctcttaacatccaaccacacagatttttttttctgaatacatttgttatttcactaatagactcctagaggagcaataacctgtgtcatattcaggtttcagtatttgccaagcaatcattgcagccaagtcactgcttattcaatgggacacatcctctgaactatcataatacctatttcatctctctttttgattttgagtttttacattgtctcagattattttaacaacaaccctctgaaacactaaaggtaagtaaatatgaaaaaagaagtaatatatttttattgaaattttattgagatagttgtagattgacacgcasttataagaaataataagagagaacttgtatatccttcaccttgtttcccccaaggataacattttgcagatctgttacaaccaggatgttaacataatctacccatcttattaaaaattctgctttacttacacttatatgtgtgcgtatattttctatacagttttatcacctgtgcaacttcatgcattcatgaccatagtaaagatatgaataatttcaaaatctttcccccatgttgtccttttacaaccatagcgagctccctcttgtccctcctcatcctcacccaaccccataagtaatatattttgatggagtagaaagttgacaggacaaataatattttaagagtttttttccaaggcaacataaaattcactttcattaaatagaaaaaatgttttagctcaagactactttagaagattagatcagccttgcacaaatttagaaagtattttaggatccttaagcacctaaaaagaacatggaccatgactgttatgtttattagagtattcactatagttagaaataaagcctgacagcagtcaaatatttgtttaataaatgaatgttagtaataaatgatctcataaaagaaatgcaaaagtaaaagttacttctgacaaaatgagtcaaacaagtattgtattacaaatctatttagcacaaattaaaaaatggaagaagcctttttgccaataattcacaaaaatataatattcagtgtggctgggataaaacgaacttggtcctttcattctgctcatggaaccataaattgttataacctctctagaaaacaatttggtaatatatgatcagactcttaacagtttgcatatattttgacttagtcaaaatgcatcttaggaagtaatcaaagatgtataaagattttaatattctaaaacacattttttatttctagtgttaaaaattttgatattctctaaaagttcatgaataagggcaaagttaattaaaatatgataattaaatgagaccttataaaacaattttctaagttnaattttgaagaaaattacaggacccaggaaaatatactttgtataatattaagcttaaaaatggcagaacnctaaattgtataaatacagtgagctgctaatttttaagaaaagagtaaaaggatatgtttncttgcacagccatatctggctgtgatgacagtgttggatcaggggagatggaggagggaagggagatcagggaagggggttcaaagtgaagttgactcaaatagtccaaaaggataaataaaaatggccaagctactcatagaatgttgtagggtctctacatgtcatctcacttaaacagactgtttatccatgcctgaaattcccacaaagggatacactcttatctcctttaaacaccttgaaacagagattcttaaactttctagactcatggcatctttaatgtctcatagcactcttgggtcaaaacaaatacctaaacatttgtttattcactagttaaggaaaaacagattgataagtatttaggtctaacaaatgagtagccacctgaaaaataatccatataaataagtaaatgctttcatttcrttttcaaataaccacaatcagtcactaaggagatgtaagttgggccacagttcttcagaccttggaattagattggactggacagggagagcctgatttcatgttccatgatgatttttggctgtacttgctttttatcccagcaactaccaaaaacccaattttgcaaagataatgacatcattgaatgtattacaaattactattgaaactgtgaaccttgagctagtagtttgtgactggtgactaacagatgtcactgagtttctcttgaaaacaagatatcctgtgaggaccttggaaattcactgaggtacctcaagttttagaccattcaagtaacccctctgggtatatttaagccatgttttagaacattctgcaccccgtctggctcttatagtattctgctttttatgatagatttgtgtgtacctgtagtagaaattgctgtcttttgtggcttttatctccttagcatcttatggcattctctatacataatgttatattggcrttgaattgaagagataacctatgtattttagacataattataatcagtttattatgttcataattcttatatattgaatgagtttatatttaagtaaagtttacaggtaaatcaaactaaagattttaatattctaaaatacattttttatttctagtgttaaattattagaaaatacagagatcactagatataaagtgtcataatttaatattacagtctatagtattaactatatatgtatatattatagttattaaatgattctactcatcctggtaattgctttacaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacaktagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatattttatttttatgtatcctgtcttataacccaataacataattttcattaaaaatgtgttttcagtatagtttgaagtcaggtagcatgaaacctccagctttgttctttttgcttaggattgtcttggttatgcgggctcttttttggttccatatgaagtttaaagtagatttttccaattctgtgaagaaagtcattggtagcttgatggggatagcattgaatctataaattactatgggcaatatggacattttcatgatattgattctttctatccatgagcatggaatgtttttccatttatttgtgtcctatttttttccttgcgcagtggtttgtagttctccttgaagaggtccttcaaatcccttgtaagttgtattcttaggtattttattctatttgtaccaattgtgaatgaaagttcactgctgatttggctctctgtttgttattggtgtataggaatgcttgtgatttttgcacattgattttttgtcctgagactgctgaagttgcttatcagcttaaggagattttgggctaagacagtggggttttctaaatatacaatcatgtcatctgcaaacagagacaatttgacttcctcttttcctatctgaataccctttattcctttctgttgcctgattgccctggccaaaacttccaatactatgttgaataggagtggtgagagagggcatccttgccttgtgccggttttcgaagggaatgcttccagtttttgcccattcagtatgatattgactgtgggtttgtcataaatatctcttattattgtgagatatgttccatcaatacctagtttattgagagtttttagcatgaaggctgttgaattttgttgaaggccttttctgcatctattgagataatcatgtgggttttgtcattggttctgtttatgtgatggattacgtttattgatttgtgtatgttgaaccagccttgcatcccaggtatgaagccaacttgatcatggtgaataagctttttgatgtgttgctggattcagtttgccagcattttattgaggatttttccattgatgttcatcagggatattggcctgaaattttatttttttgttgtgtctctgccaggttttggtatcaggatgatgctggccccataaaatgagttaggaaggactccgtctttttctattgtttggaatagtttcagaaggaatggtaccagctcctctcttacctccgataaaatttggctgtgaatccatctggtcctggactttttttggtaggtaggctattaattactccttcaatttcagaacctgttattggtctattcagagattggacttcttcctggtttaggcttgggagggtgtatgtgtcaaggaatttatccatttcttctagattttctagtttatttgcatagaggtgtttatagtatgttggtagtttgtatttctgtgggatcagtgatgatatcccctttatcagtttttattgtgtctatttgattcttctccctttaattcttcattagtctggcttgcagtctattttgttgattttttcaaaaagccagctcctgtattcattgattttttgaagggtttttcgtgtctctatctccttcagttctgctttgaacttagttatttcttgcttctgctagcttttgaatttatttgctcttcaaactatactacaaggctatagtaaccaaaacagcatagtactggtaccaaaacagatatatagaccaatggaagagagcagaggcctcagaaataacaccacacatctacaaacatctgacctttggcaaacctgacacaaacaagcaatggggaaaagattctctatttaataaatgttgttgtgaaaactggctagctatatgcataaaactgaaactggaccccgtccttacaccttatacaaaaattaagtcaagatggattaaagatttaaacataagacctaaaacaataaaaatcctagaggaatacctaggcaataccattcaggacataggcatggacaaagaattcgtatctaaaacaccaaaagaaatggcaacaaaagccaaaaattgacacatgggatctaattaaactaaagcgtttctgtgcagcgaaagaaactatcatcggagtgaacaggcaatctacagaatgggagaaaagttttgcagtctatccgtctgacaaaaggctactaaataataataatctacaaagaacttaaacaaatttacaatacaaaaacaacaccatcaaaaagtgggtgaaggatatgaagagacacttctcaaaagaagagatttatgcagccaacaaacatatgaaaaaaagctcatcatcactggtcattagagaaatgcatatcaaaaccacaatgagataccatctcacaccagttagaatggcgatcattaaaaagtcaggaaacaacaggtgctggagaggatgtggagaaataggaacacttttgcactgttggtgggactgtaaactagttcaaccattgtggaagtcagtgggcgattcctcagggaactagaactagaaataccatttgacccagccatcccattactgggtatatacccaaaggattataaataattctgctataaagacacaagcacacgtatgtttattgtggcactattcacaatagcaagacttggaaccaacccaattgtccatcagtgatagactggataaagaaaatgtggcacatatacaccatggaatactatgcagccataaaaaatgatgagttcatgtccttttcagggacatggatgaaactggaaaccatcattctcagcaaactaacacaagaacagaaaactaaacacctcatgttctcactcatgagtgggaggtgaacaatgagaatacatggacacagggaggggaacatcacacactggggcctgtcgcgtggtgggggactaggggagggatagcattaggagaaatacctaatgtaggtgatgggctaatgagtgttgcaaaccaccatggcacgtgtatacccatgtaacaaaactgcacgttgttcacatgtaccccataacttaaagtataataataaaaaaatgtgttttcagtttttgttttggtgtttttaattgtatacttccaatcaaagaaagccgactgactaaatgcaggcagtgatatcttctttatcttaaactcacattaagatgatagaaatataaaaatatgaaacagcagatcaggaaaactggtaagctcagagcacttaggaatttttggaagatatataaaagggataacctgatgataaaatccaacagatatgtctaaaccactcatcatactgggaaaaagtagactagaatagaaccataggattttcatcaagattaaaaacaaaaagggctacaggtttggacagttttgtgagtagttaatggggaaatttattataaggataatctaatgagcacaattgtacttatctcaagttggaagcaccaggctccagtatttccttcaagctagaaccacagaaatgactcttaataagatgaggtatcttctataggagggcattgcggagctggactgagagggggaagactgcccagcaagaagcccctgtgcccataaacccagttccatgtacaaccaaatggaaagttttccttgcttcatgcagtctctcacatgctaaagagattgctttggttggaactgaagttgtagagagtttaattttgtaaatgctcagaaatcatgttataaagttaaaacattttttaaaacgtaaaggttaaccacaaatagcatagaaataaaatgtcaaattttatgagaaatataattttgtaaaaaggaattttgaaagagaaacaaaaaaatagtaaatagaaaaaatacatgtaagcatactcatatcccaatatataaatgagaatggattaatttcctttattaaaacataaatgaatcaatagacttttttatatctgtgatttggctggttttttgcctttccaactaaaaatgattttgcctttacatagttttaatttgtaagtgttctttaagtactatgaatctgagtgaacacatttcttatttcctactctttaaaaactttggagatttgatcatgacagcgaagtaggcatacatatatcacccccttggatatatgggtaaactcctcctcctgccaaatccattgcaatgaaagacaaaatgttatagagagaacaatccatttgaaaatggagggttagggctaggtacggtggctcatctgtaaacccaggccttagggaggtcaaatggaatcgcatgagcccaggagcttaagaccagcttgggtaacatagtgagacccctgtttttactaaataaataaataaagctgagcatggttgcaagtgcctgtaggaccagctactcaggaggctgtccccaggaggtcaatgccgtggtgatctatgtttgtaccactgaaccccagcctgggtgacagagcgagactctcttaaaaaaattactaaaaaatataaaacaggtgagattagattagcaaagaaaccatgagggaagagtggggaaacaaaacatcaaacttatgcacagtgaaaaactacttcaaaggaaaaagaactccaaccacacagtaaacacatataaaaacaaagatggggcatctgtgtaattacagagtatcccaattattaattatcaggatacttaattgtagaaaattgagaccgtgaattttcttgcctttttcttacttatagaaaacttccagcatcagacaaaataattcatgacataaaaataataagtcgttaatttaaaaacttatttaagacaagacaataaagattaaagtttttaaagagctagaaactagggagaatagttgtcacatttatagtatataaagaacacttacaaatataaaggcaaaataattttaatgagaaaaatgtgagaacaggcaatgtggggaaattttagcttaccagtacttctactgaggttataaataagtacagtcattctggaaagcaatatggcagtacttattaaaatgttaaaggtatatagcattcaacatggcattctacttctagaggacatggaatacctttaatacattatagacatgtgcacaaagagtcttaatgaatctttatctcttttaataaaaaaaatttgtacttatacatcaaaagaaagaataaatgtcaatatagtcatatggtagaatattatgtgatcataaaataataaggtgggctaacatatactgattcataaagccatactataaatttaaaaattcatattgctgaacaattcatacaataagataaattcatgtaaacattctacaaaactattttatatatatgcatgtataaatacatggaaaagtatctgaaaaatattatactaataacagtgtttatctctagtgaagaaagttgtatttaggcattgagaaatgtggagagttgtaaagaaatggaaggaagatgaaggaaataaattttaagttattcaggtgatataaatacttttaatataaaaatacttctaaagtatatgatgtaagagtttaaattctttttcatttaaacttggtgaaatagtgaaaactaaatatttgttgtttaagccacccagtctatggtattttgttacagaagcccaaacttacgaagatactcagcagacctaaaattgaaaaagtgcaaagaaaaccatacctaaggcattaaaatcaaactgctggcaaataaagaataaaacaaattcttgaaaggggtcagaaaaaaagtacataatggaataacaatttgaagtatgtctgacttctcatcaaaggtaggatggacagaagaaaacagaacaatatctttaagatcctagataaacaaaaaactgtcaaagcagaattctacgggcaatgaaa

SEQ ID NO: 17728 - DNA, 23393 bp, Homo sapiens
  misc_feature (1)...(23393): n = A,T,C or G, or insertion/deletion polymorphism (see Tables 1-2)
tccaccacccaccccaccacaccgcctctttctctcacaccgaatagcattcaagaatttccactgtgggctgggcgcaggggctagtgcctgtaatcccagcactttaggaggccgaggtgggcgaatcacctgaggtcaggagttcaagaccagcctggccaacatggcaaaaccctgtctctactaaaaatacaaaaattagccaggcgtggtggctggcgcctgtaatcctagatacgtgggaggctgagttaggagaatctcttgaatccgggaggcagaggttgcagtgagctgagattgtgcccctgcactccagcctgggtgacaaagccagactccatctcaaagaaaaaaaaaaaaattccactgtatgtgtgcagcaaaccatcatgacacacatttacctgtgtaacaaacctgcacatcctacacatataccctggaacttaaagtaaaagttgggggggggggtaaaaaagaatttccaccgtgacattattgagtatagcaaaaaaaaaaaaaacaagaaacagcctagtgttcattagggaataaacgcattcaagcagcatcaaaccctgcagccattacaaagagatctatgttgaccatgtggaatatctccaagagccacagtagcctcccttatctgtaggattcactccaagaccctctgaaaccatggataatactgaaccctatatacactatgttttttcttgtatatacatacctacgataaagtttaatttataaattggcaaagggtatataaatattccttctaagagattaacaataactaataaagtagaacgattaaaacaatatactgtgatcaaagttatgtgaagccaggtgctgtggctcatgcctgtaatcccagcactttgggaggctgagacaggtggatcacctgaggtcaggagttggagaccagcctggccaacatgacaaaaccccgtctctactaaagataaaaaaaattagccgggcatggtgacacatgcctgtaatcccagctacttgggaggctgaggcaggagaatcgcttgaacctgggaggcggaggttgcagtgagctaagatcacaccattgcactccagcctgggcaacaagagtgaaactctgtctcaaaacaaaacaaaacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcatctcaaaaaaaaaaaaagaaaaaagaagtccagaaacccgcggagacactatcacactatcccccccaggctggtagtgcagtggcccaatcatggctcactgcagcctcgacctcccaggatcaagtgatccttccacctcagcctcccgagtagctggaagtataggtgcacgcccgactgattttttttttttttttttagacggagtctcactcttgttgctctggctggagtgcaatggcaggatctcggctcactgcaacctctgcctcttagattcaagcgattctcgtgcctcagcctcccgagtagctgggattacaggtgcccaccaccatgcccggataattttttgtatttttaatagagacagggtttcaccatattggtcaggctggtctcaaactcctgacctcaggtgatccacctgcctcagcctcccaaactgctgggattacaggcgtgagccaccgggcatggcctttcctggctaattttttaaatttttgatagagatggggtctcagtgttgcccaggctgatcttgaactcctagattcaagtgatcctccctccttggtctcccaaagtgctgagattacaggcgtgagccaccgccccgggctggaaaatacttttttaaacgagggcaatgtgaatctgaaatgccatttgaggaaagatctgttcgcctgacatcctgtttgagcctgggtggacaggacagcacctgccagcatcgggaagcactgcagatgggaagaggcttggtcactctccaaaggtggcaggagttggagggggtgagctgaaggtaaggagaaaggaggtggggacccaggagacaggggctgcgcagcgggctcggggctgacacccccacggatacagttcactggggctcaaacataaaaggaacccaactattgtgggaggaaaagactcttctgcctttctgccttttctttttttctttttctttctttctttttttttttttttttttgagacagagtcttgctctatcgcccaggctggagtgcagtggcgtgatctcggctcactgcaagctctgcctcccgggatcacgccattctcctgcctcaacctcccgagcagctgggactacaggcgcctgccaccacacccggctatttttttgtattttttagtagagatggggtttcaccatgttagccaggacggtctcgatctcctgaccttgtgatccgcccgcctcggcctcccaaagtgctgggattacaggcgtgagccaccgcgcctggctcttttttctttctttttttttttccgagacagagtttcactcttgttgcccaggctggagtgcagtggcgcgatcttggctcactgcaacctccacctccagggttcaagcgattctcctgcctcagcctcctgagtagctgggactgcaggcgcgcaccaccacgcctggctaatttttgtatttttagtagagacagggtttcaccatattggccaggctggtctcgaactcctgaccttgtgatctgcccacctcagcctcccaaagtcctgggattacaggcgtgagccaccgtgcccagcctgacccctctgccctttcaaaaactatgttcgttctctcacagccttctcttgtcatattaagtccacaccgcaggcctaatttgtccagtgaatgctatgcaaatatttcatgcacctgctgatcgcaggaatgatatgtacttggtacgcactgatcgtacctcggggtgggagaagagagggcaaggaagcaaagaatagccccctcctttcctggtgcaccttcagatgtgccgatggggcccaggctcgctgcagatggcccccttcccagagacaggggaggatcctccacccactccccagcctccaggaccatcctgactcctgccttcaggcactcaagttatgcgtctagacatgcggatatattcaagctgggcacagcacagcagccccaccccaggcagcttgaaatcagagctggggtccaaagggaccacaccccgagggactgtgtgggggtcggggcacacaggccactgcttccccccgtctttctcagccattcctgaagtcagcctcactctgcttctcagggatttcaaatgtgcagagactctggcacttttgtagaagccccttctggtcctaacttacacctggatgctgtggggctgcagctgctgctcgggctcgggaggatgctgggggcccggtgcccatgagcttttgaagctcctggaactcggttttgagggtgttcaggtccaggtggacacctgggctgtccttgtccatgcatttgatgacattgtgtgcagaagtgaaaaggagttaggccgggcatgctggcttatgcctgtaatcccagcactttgggaggctgaggcgggtggatcacgaggtcaggagttcaataccagcctggccaagatggtgaaaccccgtctctactaaaaatacaaaaaaattagccgggcatggtggcgggcgcatgtaatcccagctactgggggggctgaggcagagaattgctggaacccaggagatggaggttgcagtgagccaagattgtgccactgcactgcactccagcctggcgacagagcaagactctgtctcaaaaaaaaaaaaaaaaagtgaaaaggagttgttcctttcctccctcctgagggcaggcaactgctgcggttgccagtggaggtggtgcgtccttggtctgtgcctgggggccaccccagcagaggccatggtggtgccagggcccggttagcgagccaatcagcaggacccaggggcgacctgccaaagtcaactggatttgataactgcagcgaagttaagtttcctgattttgatgattgtgttgtggttgtgtaagagaatgaagtatttcggggtagtatggtaatgccttcaacttacaaacggttcaggtaaaccacccatatacatacatatacatgcatgtgatatatacacatacagggatgtgtgtgtgttcacatatatgaggggagagagactaggggagagaaagtaggttggggagagggagagagaaaggaaaacaggagacagcgagagagcggggagtagagagagggaaggggtaagagagggagaggaggagagaaagggaggaagaagcagagagtgaatgttaaaggaaataggcaaaacataaacagaaaatctgggtgaagggtatatgagtattctttgtactattcttgcaattatcttttatttaaattgacatcgggccgggcgcagtggctcacatctgtaatcccagcactttgggaggccgaggcaggcagatcacttgaggtcaggagtttgagaccagcctggcaaacatggtgaaaccccatctctactaaaaatacaaaaattagcctggtgtggtggtgcatgcctttaatctcagctactcgggaggctgaggcaggagaatcgcttgaacccgtggcggggaggaggttgcagtgagctgagatcatgccactgcactccagcctgggcgatagagcgagactcagtttcaaataaataaataaacatcaaaataaaaagttactgtattaaagaatgggggcggggtgggaggggtggggagaggttgcaaaaataaataaataaataaataaaccccaaaatgaaaaagacagtggaggcaccaggcctgcgtggggctggagggctaataaggccaggcctcttatctctggccatagaaccagagaagtgagtggatgtgatgcccagctccagaagtgactccagaacaccctgttccaaagcagaggacacactgattttttttttaataggctgcaggacttactgttggtgggacgccctgctttgcgaagggaaaggaggagtttgccctgagcacaggcccccaccctccactgggctttccccagctcccttgtcttcttatcacggtagtggcccagtccctggcccctgactccagaaggtggccctcctggaaacccaggtcgtgcagtcaacgatgtactcgccgggacagcgatgtctgctgcactccatccctcccctgttcatttgtccttcatgcccgtctggagtagatgctttttgcagaggtggcaccctgtaaagctctcctgtctgactttttttttttttttagactgagttttgctcttgttgcctaggctggagtgcaatggcacaatctcagctcactgcaccctctgcctcccgggttcaagcgattctcctgcctcagcctcccgagtagttgggattacaggcatgcaccaccacgcccagctaatttttgtatttttagtagagacaaggtttcaccgtgatggccaggctggtcttgaactccaggactcaagtgatgctcctgcctaggcctctcaaagtgttgggattacaggcgtgagccactgcacccggcctgcacgcgttctttgaaagcagtcgagggggcgctaggtgtgggcagggacgagctggcgcggcgtcgctgggtgcaccgcgaccacgggcagagccacgcggcgggaggactacaactcccggcacaccccgcgccgccccgcctctactcccagaaggccgcggggggtggaccgcctaagagggcgtgcgctcccgacatgccccgcggcgcgccattaaccgccagatttgaatcgcsggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaaygtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcrgagcttgcagtgagccgagattgcaccactgcactccagcctgggcgacagaatgagactccgtctcaaaaaaaaaaaraaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggtcttgaactcctgacctcaggtgatccacccrcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtctcgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcmcaagtaattgggactacaggygcaccccaccatgcccaccttatttatttatttatttatttatttatttattttcatagagatgagggttccctgtgttgtccaggctggtcttgaactcctgagctcamgggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctccygggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcrccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggcttyattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactragattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaartagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtartcccagctactcgggaggctgaggcaggagaatggcgtgaacctgggaggtggagcttgcagtgagccgagatcgcgccactgcactccagcctgggcgacagagcgagactccgtctcaaaaaaaaaaaaaaaagtaggctttcatgatgtgtgagctgaaggcgcagtaggcagaagtagaggcctcagtccctgcaggagaccyctcggtctctatctcctgatagtcagacccagccacactggaaagaggggagacattacagcctgcragaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacggggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcaggraataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcrcaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccacygcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccrggcatggtggcacgtgcctgtagtctcagctactcaggaggctgaggtgggaggatcactttgagcyttgcaggtcaaagctgcagtaagccatgatcttgccactgcattccagcctggatgacagagcgagaccctgtctctaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagccwaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatgrtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagakatatgggagcacccagcgcaggatcactgtgaacataaatcagttaatggaggaagcaggtagagtggtgctgggtgcataccaagcactccgtcagtgtttcctgttattcgatgattaggaggcagcttaaactagagggagttgagctgaatcaggatgtttgtcccaggtagctgggaatctgcctagcccagtgcccagtttatttaggtgctctctcagtgttccctgattgttttttcctttgtcatcttatctacaggatgtgactgggaagctctggtttcagtgtcatgtgtctattctttatttccaggcaaaggaaaccaacaataagaagaaagaatttgaggaaactgcgragaaagtgcgccgtgccatcgagcagctggctgccatggattgaggcctctggccggagctgcctggtcccagagtggctgcaccacttccagggtttattccctggtgccaccagccttcctgtgggccccttagcaatgtcttagraaaggagatcaacattttcaaattagatgtttcaactgtgctcytgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgtttttttttttttggtagatgcatgacttgtgtgtgatgagagaatggagacagagtcccyggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcasggctgaagtctggcgtaagatgatggatttgattcgccctcctccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttmtgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgcttagtaattggctttgtagagaagctggaaaaaaatggttttgtcttcaactcctttgcatgccaggcggtgatgtggatctcggcttctgtgagcctgtgctgtgggcagggctgagctggagcmgcccctctcagcccgcctgccacggcctttccttaaaggccatccttaaaaccagaccctcatggctrccagcacctgaaagcttcctcgacatctgttaataaagccgtaggcccttgtctaagygcaaccgcctagactttctttcagatacatgtcyacatgtccatttttcaggttctctaagttggagtggagtctgggaagggttgtgaatgaggcttctgggctatgggtgaggttccaatggcaggttagagcccctcgggccaactgccatcctggaaagtagagacagcagtgcccgctgcccagaagagaccagcaagccaaactggagcccccattgcaggctgtcgccatgtggaaagagtaactcacaattgccaataaagtctcatgtggttttatctactttttttttctttttctttttttttgagacaaggccttgccctcccaggctggagtgcagtggaatgaccacagctcaccgcaacctcaaattcttgcgttcaagtgaacctcccactttagcctcccaagtagctgggactacaggcgcacgccatcacacccggctaattgaaaaatttttttttttgtttagatggaatctcactttgttgcccaggctggtctcaaactcctgggctcaagtgatcatcctgcttcagcgtccgacttgttggtattataggcgtgagccactgggcctgacctagctaccattttttaatgcagaaatgaagacttgtagaaatgaaataacttgtccaggatagtcgaataagtaacttttagagctgggatttgaacccaggcaatctggctccagagctgggccctcactgctgaaggacactgtcagcttgggagggtggctatggtcggctgtctgattctagggagtgagggctgtctttaaagcaccccattccattttcagacagctttgtcagaaaggctgtcatatggagctgacacctgcctccccaaggctttcatagatcctctctgtacattgtaaccttttattttgaaatgaaaattcacaggaagttgtaaggctagtacaggggatcccgcataccgttctcctccttttccccgttgtgaggacagtgcactgtattcactttcaacatccaaggtctgtgttgagagggtgagttgtgcggcccagcttgccccaagcccgtcttgccatcacgaaggatttcctgactcagctgaatctagctcaacaaagcaaaggactaactaagctgcagattttctctccgctgggcttagcctacattatttacacctgttttcagctggatgggaccaaactggggccttgacttctggggtttccacgtgatccccaaagaggagacatccattcattcactcaggtatttgcttgtgcacctactgtgcgccaggtgccagatccaggaattgaagcccaggaacaactcttgcagtgagctccccgggtttttgttttctgaacggtgggaagacaggtcagcaaatagccatgcacgtctgcacatgtgtggctggtgtctgcaggagtaccgagaagacggtgagctctgccctggatggcaacaggaaagggcatccctgtgcagctgtttgtcctggcacaggtggcaggctgccagcgggaccaggaagggaaggggaggatgcacaggtcggagggaacggaacgggcactgcaggtgcgctctgcgatgtgaggaaggaagcaaaggctggttccgggatgatgtcggagaagccttgcagcctagggcactgcccattccacgttacccagtgagtcaaagcctcccagaaagacatttagtcactcaaagccagtgcaggtctcagctttgtccggggaggaactttcactctagaaaacacgaactcatttccctttgaggaagttgtttctccaggatatcatttccagccaccatccaggatgctgggcaggtgctgcagtgcccaaggcacggctgccgaagaagcttgtcccttagaaaccccttgtggcctcggaggcgcctgcctgcctccctgagaatggaaccctgttgggccgccaggctcgctgggcaggtgctggggaaggctgggtcaccgtgctgagcccctcacaggcctgggagttgtgcttggggaggagagctcccagctctttggctgcctcccaatcatggccacatctcacaaacaataccactgtccacgaaaaatgaaaaggtgcctggttctaacccatggccccaaccatgaaagagcccttagaatgtgggggtttgactcgaacagtggctttgagtctcccaggggggattagtgtcctaatgccctgagttaatgaattgacttgttggacagggaaactcagtgaggttcattttctgtggggggacgtttgtcaaatgctgtgaaatcagttgtagcatacgcgacgctcagctgctccgacagtgactcagccacggctccagctgcttccccagccctgtagtggaggtggcagatggtgtcatcagcctggcgcagagggctgtgcccactggcatcacaagggccaggcctgctggtcctccagccactggatccaggtagttacatatgggtttaaaagaagagaggcagggccagttgcggtggctcatgcctgtaatcccagcactttgggaagccgaggtgggtgatcatttgaggttaggagttcaagatcagcctgaccaacatggcgaaacccagcctccactaaaaatacaaaaaaattagctgggcatagtgctgggtgcctgtagtcccagctactcaggaggctgaggcaggagaattgcttgaacccggaaggcagaggttgcaatgagtcaggatcatgccactgcactccagcctgggcaacagaacgagactctaaaaaaaaaagatcaataaataaaataaaaataagagaggcagggtgggagtattacttgaggccaggagtttgagaccagcctgggtaacaaagcaagaccctgtctctaccaaaataataatttaaaaaattacccgggaatggtgtgacatgcctgtggtcccagctactctggaggctgaggtgggaggaacactcgcacataggaagttgaggctgcagtgagccgtgatcacaccactgcaccactctagcctgggtgacagagcaagacctcatctctggggaaaaaaaaaaaaagaagaggcttggaagccacattgttttttgtcacttataactagagtttcgtccatcaaaagcccattctgcactgatttcagtgataggggtctgatgctggcttggaagagggcctgacagcttagagacaggcttggagttccaagttgatgaaagaacgatgaataatgaaaaataatgtgttgttctaaagtagtgccttttcatactgagctagggtataatttgggtccatttcaagggaaatatactagcagaattcatcaaagtagcccctcgaagactggtgcctgctgcctacgggacaatttaatcagtggttccagctgcacatctagagttgggaacactgaacccaggctttctcatgcagatggggtgtggattgctaaggtggctgtctcctagcgctgcagcatgagtgaaacacgtgtccattctacagagacgcggctccgtgatgctgaaacctccttctttttttttttttttgagacggagtcttgctctgtcgcccaggctggagtgcagtggcgatatcttggctcactgcaacctccgcctcctgggttcatgcaattctcctccctcagcctcctgagtagctgggactacaggcgcgtgccaccatgcctggctaatttttgtatttttagtagagacagggtttcaccgtgttagccaggatggtctcgatctcctgacctcgtgatctgcctgcctcggcctcccaaagtgccgggattacaggcgtgagccactgcaccccgctgaaacctccttctagataacagcggcgttaagcatttttttttttttttgagatagagtgttgctctgttgcccaggctggagtgcagtgatgcgatctcggctcactgcaacctccacctcccaggttcaagcaattcttctgcctcagcctcccgagtagctgggactacaggcacacgccaccaggcccagctaatttttgtatttttagtagagacggggtttcagtatattggccaggctggtctcgaactcctgacctcatgatccacccgtctcagcctcccaaagtgctgggattacaggcgtgagccactgcacctggccaaaacctcctcctagataacagtggcgttaagcattttttttttttttgagatggagtcttgctctgttgcccaggctggagtgcagtggtgtgatctcagttcactgcaacctctgcctcccgggttcaagtgattcttctgcctcaggctcctgagtagctgggataacaggcatgagccaccactcccagctaatttttgtatttttagtagagacagggttttgccatgttggccaggctggtctggaactcctgacctcaagtgatcctcccacctcggcctcccaaagtgctgagattacaggcgtgagccactgcacctggcctttttttgttttttaagacagggtctcactctgttgatcacagccacagctcactgcagcctcaacctcctgcctgggttcaagcaatcctcccaccttggcctcccaggtagctgagaccacaggcacaagccaccatatctggccctacgtaagctttatgtgggtgcaataacagatctcaaaccagctctcagctcaagagaaggggaagctgggcacagtggctcacgcctataatcccagcactttgggaagccgaggcaggaggatcacttgaacccaggagttcgagaccagcctgggcaacatagggagacccctgccctccctgtctctgaaaaaaaaaaaaaaaaaaaaagaaaggagaggctgggcttggtggctcacacctgtaatcccagcactttgggaagcccaggcaggaggatcacttgaaccctggagtttgagtccagcctgggcaacatagggagaccttgtctctaaaaaaataaatagagtgagagagagaaggggaagtcaccgggaggacacacatggagcacgcagcccaaatggggctcctctgttctccctgcagagtcagttcgtacctttcacatgcacaaaggtgttgatccaaccgaagcaatattgattcttgttatattgctttattgtggggtcagtgtcagagtaccacgagttttcatcacgcaccgttctttccccagctgcagtgtgtttagggggggaacgaggccccaccccctatccctatcgcctctgcctttataacggctgctactctctgagcacctgttgagttctttcaccttccagatctaatgtgctatccccacccctagagaacagggctgctggatgccacatggctcccagagaggggctgtggtcagggaagccccagctccaagggggctggaaaaccccagagctgcccacgtgcggcaacacagtctggtgctgcaggtgtgaggacggctacaaaatacctgagccattctgtcactctgtctgaactctgtttgaaatattgtttcaataactgctaggctggtttttccttcctgactatattcctcaaaccaacaagagcctagcagaggaaagcatggccaaaacgccccaagaagagagccttggcttcacctccaagggccaccatccgggaggatgtcctcagacctctgatcccctctctgcaggctctgcccagccctgtgtggcaacccagaggaagcctccccttcgtttgagatttaaccccagaccttaggcgatggctgcccagcctgtcccttccgcctgtgtggctgcccacgcgggcgttgctcatggggctagtcctgggtggatgggtgggggcctctcgccggctcctctgcctcccacccccactggcaccccacgcctgtcctagaaggttctttctgcctgttttctccgtgagtgactggacaggcagaggccggccttgctggagggggcatttgtaattatgagtgaatccaaaacaaggttttttccttccgcagccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccct

SEQ ID NO: 17729 - DNA, 222160 bp, Homo sapiens
agaacactgaggcttaaattctttaatacttaactaagtctgtagactttgcaatattggtactgcatccataatcatgccttagtgaaatgttatacagaacatcattcagaatgtttgctctgaaaagactttggataaatgtgccgtatttgaaattgattaatggtgtctgatatgcatccagtcttcttattatcccaagaatttgacttaagttacagggtatcttgtatatttaccctacttgaaagacataatttgcatttaaacaagaatggtgcccatagctgtgttaattttgattaagtgttcttcctcccgggacctcaattacctacctcatatgttatatgaggtagttacattattccagtggtttatctaactgtcctggaaacccttagagtgtctacaggaggaggtgaaacctcaggctgcttacaaagattcagcccaaacagccccacctctaacagcttattaattaccttgcacaataactcatgtattcatgaacctgactttttgaatccaatagtgtctactatgtgactattttaaacatatggaagaatgtaaaacagacacaaacttctgtcctcattgagatttcattctagtagagagacagacaataatcaaactacatgagttaaatggatattatgctatatggtgataaactctatggagaaaaatgaagcaggaaaaggaatttgggggctgggactgacagtttaaatacttgtttatggaaggcttcaatgaggaggtaagctaccgtaataacttggggaaaagagttccaaggagtggaaagagcaagtgcaaaggcaccgatgtgggagtatgcaaagtacatttaggagcagtgaggagactactatgatttgaataaattgaacaaggggcaaatataaaactggacttcagagtatgcatgtattagaagaaaaagggttgcttttaagcattgaaaacagttcacttaagatacttctaaggccctgaaaagcattaaaattctaaagttctttcttataatatatgatcagtgatccttgactccatgttattaatacttctttttttgttaatcaataatagagtttttgctccttagggagcaaaaacatacatttgtccaaccatcgtttgttaatactttcctgtgaacttaactatcttacttaagaggaaaatagtatggaaaattggggcctagtaattaattaattaattagactttctagaaatccattagatccaaagtgacttttttgctttagaaaatcaaatatatattattttcatatttttacagtcattatatattcacctcatattcctgaatagaactattgcagatcataatgggtaataaatatatatcaaagaaattagagataactctgggaaacttcttgaaaatatataattcaagttggaatttctttaaaggcatcaaacacttaaatagccataccttgagtcattttctacttactcaaaactaaaagacctgcttatttcagttgaaagtgggaaaactttgaagagaaatcctcaagttaaggggtaaacccagactcttacactttttgtatgtaaatttatacacttactgaaatcacccacaaattatgagtttttaatacactgagagtttttgaaattcatttaatatagtgtaagtttcatagtcaaatagcgtagctaaattctttcttcattcctcatgtctgagacaggaaggaaaatgactaagtggatttctagttcaactgaaatagctatgtatttctttttgtacccagactgaacattctgtgaaataagaacataatgtttatcatagactttgaaagtttttactctcctgagcttcagtgatatgtctttattagctggcattattgaaaaggtgagttgcagaattgtattaattcattgacagatgatactgttaacaactgaaattaaacaataaaattcaatggacttgggaagagatatacccagaggtcctccatgtgtatttaatacaataactttggaaatcatttacttaaaaacaacttggagtctagaataaaacagaattttatattatacagatgtaatctctgtgcctctttaagattgtgtttcttcctagacttaatataaatcccacttaggcccttatttcaatctttgtcatcagtatattagcctaagccctagcttgatcacctagaacctttactaatcaggtttctgtgctcagcatgggccactttgttttattctaattgatggcatataattttagtacagcctttcttctgtagattgtttcctcactttatacttcatagttatcaccttgttgactaggacttgactcattctttttgcctttcctaaaccttagtctgcctagaccaatcattgaagacccaatggaaacccctttcatcttctcatatcatgaacccttgtaagattgtttgaaggcttatattccattaggtatttttctcaccacttatcatccattcacaaaaatttatcaagtgtccaatctatttttaagtatggctgaacatgcattcaccgtaggtgacgcttgaaggagagaagagtgaatcagatttgttgcatgctctggaactgcatacaattttgttcaaggagtaggaaggcaaacaaaacacaatggtatacagtggtaggaacaaatgttctcagcttccaaaactatctttgttgaaatttcatctccagtggaaattttggcggtgctaatcaggggagaaaaactacttccattcttcaaaggcacacacaattgactcggctatgttgtcacatactgatgggattaatattttagtacagggaaggggtcctggcctgagccttgggaatcctgagtccttatctcaacagaccgtaagtaggaaacttgcctccggtaccatgtcactgcttttgagcatatcatcctgattgatgatgaattcctttatacttaaaatacaaagctcttctcatgtcccaggtaacgtgaaattttttccccctggataaatgttattcatttttccctttcagcaagatgtacccttatgattctctgatgcatgactaaactatacaataaatattattggaatactatgtattctcaattgtaacaaaagtgactgtgatctacatgtagctggaaacactcttcctctcaagaattaggtaagatggatccaatcccacattgactagattttgaaagattaattcgattacattactttgtggagcttacatttttatgtttatttctaactctgagctcttgcttatgctacattatttcagtttagaagtggtcttgtcatctcatatgcactgtatctggcctacgcagatagggtgcgctgctttattaataaatttccttaatgaaaatgtgtgtgaaaggatgagagaacttatgtttaaatcaatcgccccaccaaaaaaaccatacatttattgctacgcattcttgataagcaaagtggatagtgatgagcaaagtagataggaattcagttcaagaatcagaatgcctgggtagaaccctggctttaccattgctatgaatcattgtgtgaccttggaaaagttgcttcgagtctctgggtttcagtttcttcatgagtaaaatgaggatgaaaatagcaactccttcaataaatttttatgaggggaatacatctattaattcatataaattgcttagaatattctaacatgtaagtgttgctaattaatagatctaaagacctttgaacatttctaaactcatgctttgtattgttgccttcgtccccactcccaggccaaatttctattttcatggttattattttgtttaatatagagccgtttcaccatttttttttaatgaccaatagcctttggagttactagtccaagtggcttatcaaggcattttcctaaactaggacacattcctttctaaaaacaattctggaagcagtggactacacattcaaatatatattatacatatgcccatatatatatgcatgtgtttgtgtataagtataatatgtacatatttgtatagtcagttgctcccagaattccacgtgtgtgtttgtgtgtttgatctcatttgatcttcacagcaatcccatgaggctagcactattatcactttttacaagaaaggagactgaagcttaaagaggttaagtgagttgaccaagatcatacagttagtgtcagagcccaaatcagtcttccttttgcaaatctacctttaagcaattatgctgtattaactcccatcgtaaaatagaggagatcagatagagcgttcgcggacctaggttaaatatattgtcaggtcgatttattctaatacaccccacttacaaccacagtgaaaaagaaaacaattccctaaagcaattctacaggagtccatggaaatgctagcatttcagccaagcttagctcaaggaatatagagttaaaaggcatttgcctcctagcgatagccttcctgttgattcataagatgcaaatgaaatgttaatgtttaaaccaagtgggagaaactacttattttgagaggaaaaaaatatggtataaaagctctactctagaatattgttaatgtaaggagaactggaagaacaggacaagcaggcttttgagaaaaatcacagctgaagatagggcttaatagtttagagcactaaaagataaacaattttaaaaatcagtgtgtgagtgtgtgtgtgtgtgtgtgtctgtgtgttgcgagtctccaatctcgctggtaactcgcagttttctgatgaaagtgcagtatgtaacgattactagttggcatcctctgctggagaccagtctcacaaaagggtgaccctgtgatgcacgaaaggctatttaatgccccagcgaagtgcttcagggaccaagattttattattctttggtgatgagagttgtgatcctgcatccctgatttagagccacttagggctccgacagctccaccccggtgttctagaggaaaatcttccttcatgctctctgcctgatttgaaagcaacacagcttcccgatgttcctcctgggaggtggttcaatctttagaaattgcctaagaagcctgtccatctgctggagtgcctggctttcgggaacggaccaagacggacttggcttttaatctgaaataatttgaggattttctgtctataacttaaaatcaccgcttaactcaaagtaaaaaagtgacacgctctctagagggcttttgtagacattgggaaaatccgtatgacgaagtacggtttagaaattccggatttaatttcccccgggaaaagcaaatatcttctgttggtaccgggcagtcgactcacgtagtcttcctttaaaaccaagtctatgccagccgggtgtgaggggagtggtgggggtgagcagggggaggagagagattcgaaaagtacaggaggaatcagtccagtacaggggttgcccctgccaacaagtagctattcctgttaactcccaagaagcaagtttccacctttgccacttcctcctgccctttcctttccttttcccttcactcccgctcttggacccaaggttcgctccccaccgccaccgccctgccccactattctctttacaggacagaaggctgcagcagcacggcggagaaaaatctctgaggaatgagtcagtgggatgggcgtatgggtggagggagagggcagtcgatttttaaacctcagcgagggtgggtgggcagttggaagccagaggccttatcactggggcgctgcaacatcacagaaagtgttagtcccagggctctccctggcgcgcgcggctcctgtgcttgcttcttattggcggacctggccctgggggcggagccgcggtgaagcaccgctcatccgggctccaggaccggggcacgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggygtggactccgtcagtggcccaccaagaaggaggaggaatatggaatccaagggggccagttcctgccgtctgctcttctgcctcttgatctccgccaccgtcttcaggccaggtgagcaagggcctgggagcagccccagacagacgtgggcctggagcagtttcctaggtccccgtcccagcctcgcacccccgaggcagtgcgcccaggcgcgtggtggaggtaaggggaccgctgtcctggcacagagctgtccccgggctcggtcacctgtgccgcacgtttgggcttggctggttagctcaagtttgggcatcaagctggggaaactgggtgaatctccaggaacttggtgctccggggtgggcaggattcgcctgacgctctccccttgtccctgcggctcccagctaggcggcggactcttgccctctgacagttcctcctgtctctgggtatccaagtccacgtcactgcgccccgagcagtttttctttcgcttagttctcggatgaaataactgccggcactttttcgtgataaatcccctagtaacttccccttggtgagccgaggaagggatgggaggggtagagaaggagaggactttaatcacctccccccgccccccttgcgaaacctgctaaagcttaaaatcgtggtttcaacgttaccccctgcggtccccgtccattgtctgggcgggtggtgagtgaaagggtgaccgcaggcagataacacagccagaacaggaattagtaggtaggcctgggagacacctcagtgagaggtttgtgaatttccaggacctgctcatagagcctcagttctcagttctgtactgagtcttggaagagagagagagagagagagagagagagagagagagagagaaaaggcaaaattcccaacaactaaaatatctctcgggaaatccctttccacaccctcggggacgtcccctggccctggtatcctcaggcccgcctggcggctgacacaagttgttctaacagggtattccgtgcgctcacagttgcctgacagagcagcaggttcctttgctcccctaaactgaaaatttaggggatttttttttctttgaagttttttttttctatccctgcgtagacagttgccagttaaactcctacttcctggtattttggcctgtttgttcttagctttttctttagcttttatcaaagaaaaatctcacttccttttatccgtgcacatcccttcagctgtcggcaagctcaggtcacagaagaggtttgaaagcctctgaatctctcccaggaactggcggggagaggggtttgggggccagagcctgaggaagagattacaagtgtttgcgagctgctgctgctgctgccgttgctgtgtgtgtgggcgggaggagtgccctctccagatctctttattaaagttacatttctgggtgaggtaatgagctcacctgatgtttctgaggctgagggaaaaaaaaggcgtctgcgttctctgacaaatctcgggctctggggcggggactgtgaaaccatagttcaaccggatttaaagcaggtgtcctagtgtaacaacgctggggaggtaggtggaaaggcgagacccccttgggcctggcacagtgtggatttcactttttcgagattccactgtccgatggaggaaaggacactttggagccagggaatgagccaagaagggaggacaagggtgatgtcggtttgtaacatgcaaacgtccacacgcccacagttggttttccgattaaccccctcgagacttggagaatgtaatctcaccctcgtccacacccctgacacaggcacataaccagtttccttttcggtgccgtcacaggcgggccacgtcgcaggataggtttttctacacatttaactgctaaaagggggaaagttccgctttcagacctccttcacggtggttcttttggcgccacaggctcgtgtgtccagggggcaccgagctgcgcgctttcggcgagcggctagccccggctcaccgcaaccagccaccgtgaatctgaggatccgatatcggccctggaccctcagatccgtggtttcggtgaattaccgagctggcattgccgaaattctcattgcagtatcagtgtgttttgaaaggaaaggttacagcactaaaggcgccgtgtctacactgaggaagcaagtcttggacagtaagkgcgccttcttcggagccctctgcatagcagagcccggtgggggcgcggtgccaaaggccggcttcatttgagcggggtaactgccttccctgccggccactcttcatttccggagcagttttaatagtgtatgtccagttgtagaggtcaaaaactcgagtttgtgaaactgcttccccgggtctttcggcttgtagtcgctacaaagtcattgatatattttaggcgtgccacgttacctgttttgaaaggaggagaaaaatatatgaaccacgaaaactgaattcagagatgaaggcaatgaagtgtgtgttcaacatccgagatagcaatattctcgttattcttgtagaaagagcgtcagcctgtggtgacattttgtattgcttaaaaaaagaatgcttttctggattatttacaaggagatggggcgctgcagttaactctttcttcacttgggtcatctgtatgaacccctctatgggatttttcataactactcactgatctcactgatataagattcattctaagacataagcacacataaagctttcttcagtgggatattatgtttgaaacatatcaattgatctcaacaggacttgggaaagcatcaactcaaataatgtcctttcaaagactattgatgtaggactattgaaattgattaatttaaaaactaaaaactgtttaacagccaatatatatatattttttccttaaggatttatttaatccaatagcaatttacaatttaatggagcattatttgcagtaaattgcttttctaggctttcttcaggacatctaccttcaggcacttgagcaagtcatttaacctttttgagcttcagttttctcatacaaaataaaaagacagactagaggcctactctctgaaatgtctcccagctcaaaaactctttgtttctgaagtcttaaggtaaaaaaccaatttaggcaggcagagtcatttttcaacactatttttctaaggatctcagtctagacaaaattcatataaattgtattattagaaaagtatcagtagaccccaatttctaatttcctttttttttctacctttaaaaattcatgataacatctatgcttactctttccagccttagtagggaaaaaaaaaagcgtgaaggagagaaattagccttccactctcctgggaaaagaggacccaaaagtaagaaaggatagtaggcctcagaaagccctgctagtgtaactcatctctcctgcaaacctgttcctatataaactgcatacatagtacctagaatgagatgtaaattatggtttatgcttaaatattcatatgacaaagcctcatattgtacatcctaaagttgctcaaaaagttgatttgcaacatggttgtaaatgcaagacagaaggaaatagaaaatactaatatttttctattgttttaaaacttgtagaaatccaaaatatcttgtcttaccagattccaaaccttttctgactttgtaaaaaattcaaactagcttatcttttttaatagacattcagatgaaaatgcatgtctaccattgacttatcaaaaagaagaaaattaattaaatagtcttgtgttattagaaaaattgtatattgtagtcagtattcatgtgttcagtttctaactatgtcatgtaagaatgttgtgaccttgggaaaattatttttctgctcttttttatttcccatctgtgaatttctttctgtgcaatgtgtggttctgattgtgttgagattagtaattcccttgctcagcatttcaaattttttaagtaaaacgtgctatattaattaaggcttttattatattgttaatagaataacattctttaatttattccacttaattatcacttttatcattttattaaaataatagaaagatgtttcttttttttttctctcttttttctttttctccgtcaaattttcatgccactaaccgtgggcctttgtaaaacttagtaccacctaagttgtcaatattacttggtgtaagatggcagcagtttgtcagatagtattttaaatgctttataatcaccatgttttacaattccaaacacacttctttctgttctggccatttatttagcataaaacaccatcaaagagttctagctccctgaaggtattcactcaagtagacacatgcaatttatagcccagatatgcagaagatccacttaggtatagctatgatagaagaatatgtctctgtctcaatgtatacatagaaacttaaatgcaatttctcacaatgtgttaattttattcttcattgttaagtattcacagaggctaatctcatttcttacacattatgtgtgtgacacatgtatgtgacatatgaagaatgaactaacttactggaatactaaagaatggtttcttgggtgtggtgggtgataacatttatttggttattacttttggatttcaactcagtttattttcaataagaaatggaaaaaaatccatttatacttttgattactttttttattagggtagaattttcctttccttgtggagagtaaattcaagactaaaatagatattctatattcaggaagagaatattgcaggctgtttggtaaggttaaatctaaatcctacaattattatagtgtccctatagtacgtaagtcattaccatatttttggagttactgatattttcatgcagctaatttctctgcttaaataataaattttacattctcttttctcccttattattgaatagaataccttatatatttcagataggcctagttccaaatgtggtatggtattcagtaattgttttatgctaacctattatcatagcccattactgtagtctatgttccaagaatgaaattagcttttaatgcttcctctcttatttatccagtcagttctcaattatccattccattgaaggggaaatcagagttgcgcacaatccaaaacatcttctaaccaaaggattacttaatttgactttgagttgaggtacttcaatgaacatgtctatacttgtctggtctaagaattcatagtacttcaacacaatgaaactaaactgctggggaataggttaatcagaaattagacagctgtccagcttctctgatttgcttctctattactgttattattgttttagctcttttctgtatcacttaaggaactgatgcaaaatcttggcccaagtaagactaaaaacatctatgagatgaaactaaacctttgcaatcttctcaaatcctataaatattatagacccttgatgttcattcacaggaaaacatactatgaccatggcaattgctgtagtcttctggcctttgctcaatgacacttccactatgaataatttgtttagctctgcaaaatcacatttcaagttttagaaaaattttaccctcacctggccctttttcttaagcaagttttttattacatcatatgagtttccatgaataaatgaataataaagcaatacccttttcatgttatgagttgggttagcagccaggtaggttgactctccagtaggattttcacacacctgcttttagaaaaaaaaattactacttataatggattatggggttacagtaaacagtgaaaaccagtaatatcaaatccataaatgttaggaagattggaacttgtaattaaaaaagactttatttttgattattttaacttattatgatgatttcactagagaagttaactgaatttgtagattaagatatcaaccagcactccaacacaatgttttcttgagggagataaatctcaaagatactttcaccttagaaattgatataagtagatttttatcctctccatctgtatagttttagagagagtctagattaccttatttgaactgtgaatgaagaaaaaaaaactttcctgtacttacttgcctttggtgcaaaatcaacattggaatgttgataatgactaaagtgagtcttaacttttcccttttccttttccctgtacttgtctttgctgtagtttttaccacattgtattatgatattggtgacttttttcagttgaacataaattttttgaataccaaatatcatctttgtctatgtatcctcaagtctagttaagagcttgacacctagaagctgcttcacattttttctttgcattaaatacagtagaagcaatgcatatgtggagaattaaactccatatggcagcacctgacattcatgcattactaagaaattttctcaaggagtttgggagttgaggatataatattcctcactgagaattgaactggaaaataaaaccatcatgaaagaacagagtgggacaggctatcaagacctgatggcactttagtagtattaatgaaaaacaaaaagaaaagaacatgtatattcgtaaaggacctgtgattaaggatgaaaaagactttggtcattggagaaacacagaaaaagtagaggagttgggccaaatgtggttattgaagctattatacttaatgaatccaaacactttcttttatggtgaaagtaagtggcccctctaactggcagacatgacttgcccagtctccttagcaggtatagctttttgttgagatagataaaactcattataagaacctaattctggggccaggctcagtggctcatacctataatcctagcactttgggaggccgaggcgggcggatcacctgaggccaagagttcgagaccagcctggccaatattgtgtaactctgtctctattttctttttttcttaaaaaagaacgtaatgctctgaatattcaagtcatatagtaaactttcccatggtggaatttcatggtcactaagaaatcttctaattataatgtgatgcttgttttttgtttttgtttttgtttttgagacggtgtctcgctcttgttacccaggctggagtgcaatggtgcgatctctgctcactgcaacctctgcctcccgagttcaagcgattctcctgcctcagccttccaagtagctggaattacaggtgcccaccagctcgcccagctaattttgtgtatttttagtagagactgggtttcaccatgttggccaggctggtctggaactcctggcctcaggtgatctacatgccgcggcctcccaaagtkctgggattacaggcatgagccactgcaccgagcccaatgtgacttcttatatagccagtttacagtcagaggatgcactagctggaagagaagcattgtattcccttggcaataattgctcttatgtataccaataagctggtttatgagtttggttagtgagaattcatctttaaaagatgggaaaatgtttggtaagcagccaaaagaagcttctaagttttcagggttgaaacctacacattgaacccttccaaattcagcttgtttgtggtacaatcagctaaccattccccaggtgacacctatggtgtcatttgttgtcaacttgtgtgttacctattatagacatttattttctttcttgtatatcttttggtgctatcttgcttaatatgcatattattagtaggttgaccattcattcatcttggtatacctaagactgtcctggtttatgcctcatgagctggtacaattattaatggcatcctttttcattttcagaagtgcattttgcataacatatcatacaggctccacaataatttgtaacttgtctttatgtcttggagtacttcactgtgataaatgcactcttcatcctaaccaagtgcatatttttaacccatttaaatttaattatcagctacagtgaaatatcattaatgggttatatgcccctttcatgtcaggtataagaaagaaagatgtgaggttgtagcctctagaattccagaatgttgtggatatgaaacattgaggatcctatggtttggaatggaaactaaattgacctcagatgccaagggaataattttgtttgaaattcacctgggagctacacttagctacggggttatttagggaagaactatttcagtatgagcatgaattccttttgcagcaaattgtacaactcccattctgttcttctatgagatttctcagtaatcacactaccaatttttttcttaaaaaaaccagggatgttgaaggaagccccagcattcttctgtacatgcaaactaagttgtatcagtcagaaaaggcgacctgatgtggccaccaacagtatggctaggatacggttgtagtcaagggtgtgacaacagcaaagacgcttatcgcggaaactttgaccctgtattaacaattttcaccttctagatccttgggcaaaacatacggccttttgagaggctcaagcagtgttgaataagaatactttcacttagagcgaaaaccttaactctctccagagttaaattatggaaagttcagtgtgtgtgagtttgtgtgtgttgggggctggagaggagagagaaagacagagacagagagagagagagaatgaattctgaaggattagaggcatggaatttattgtcacaagttaaaatatggtaaaagaagggttgttggaaaaatgagaatgttcttttgatgttctttttgtttagccccccatttgagagctgaaataaatgaaaccacaggtttaagagattacctaaaatccagtagcaaattaaccacaattcctagtgacatgttttcagtttcatttgcgcctaaactcatagattaaaggttttgacctgtaaagaacctaaaaattaattaactacttgactaaggtcacattgttggccaatccagaactaaaactcatgtcaattgatcattcagcatatataacagctttcaacaaatattaatggagtgctcagtatgtactacacattgtgcttgaggatatggaaataaactaattactatacattcaagatcctatcactcaaagatgttatgttctctcagggaaacagatatcaattaattaactatataactatttgctagaaattttggtaaatgtcacaagaacaatgaacagcattttacaacaaaggggccagatctagtctgggatttaagagaaactcagaaaacgtctagcaggaagtgatatctgagctacgtgctgaggaataatctagcaaaggatgtaggctgaggaaataacatgactgaggatgctaaggtggtaagaaacatggtttctaactcctggaggtgaaaatgtgcctatcccttttcatgaaaactaaagaagttttgaaggttgaggcaaaaaccaaggattccttgaagttgttcaaatactttcctgcaatctccctaattgacttgccagttgtgggatctacaaaaggatgtctttgtcttattgaaatattcacatattagtaaatatttgtatgtatacctccctacttaaaaaataaagtggaaayataccatatacatcattttgtacctttcctttttcatttaacagtacattttggagattaaaaaattgtctcatagcagcacctatagctctacctcatttttaaaaagtgtgcattggattttactgtactatcatcattaatktaaccatttcacaagttcctggaagtttaggttgtttccaatctttcgttattacaaactagagcagtgaacatcctaatcatgttattgtccatataagcaattggtggcagttgttggtaaaatgtcttggaagtgaagttactgagtcaacgatgtgtttttcatttagaaagaaattgtaaaattactgctcaaagagtacacatctttaaaaaaatcccaacaaaagtaagataatgcctttcttaaactctcttcataaatctgtactattacattcctctttttaaccagtatcataagttggttttcatttatttaaagcttattggaaaagttagaattataggagtagtaggcatatacactcacatacaaggcaaaacctatattggtgcctaactttattatacatgagattgggccagaaatgggaaaagacaggtatttaccatgaatttttattattgttctttctacataagattgctaacttttagaacataaactgtataattataagccataacctcttccattttgtaaaattaatactctgtacaatcaggattaagagacagccacatttgagccataagtgaatttaatactgcttttcaacacaaagaaatggtttccaaatatttgtattagttcgttgtaggtacagtatacattttatgggtggtctgactaatgccactttgtaaaccctgtataatagtcattactaaacaaacttcagttatttttaagtaaatcatatttcgaacaattattccaacaagtttaagccttaagtaaatcatcttttgaacaattcttccaacaaagcttgtcagaattttgtataaactgataaaaagtacaatattttacaaatttttttaaaaatcagtgccactaaatatttttcacctgtaattttttaacccattaaggaaagtaggaataaaatctattttagtcacttttacatagaaaatagcaggatatatatatatrgttttgaaaaattatatgccgaaagtaatatttttaaacaaatgataaatattcataatggaggtaatgtttgtatgcacatactgtaatttaatgagtaaagcagtttctgcctggtatttagtttagatgttcaaatctggggcacttatactttattctgcaagcattttccctacctggtgataggtacaacactttctaagaagaatgtttatggtgattttaaggtataggttttatatttttgcagagatggtcatggatctaagtatgaataacagttttgatatcagatctaagagtaaaatgtaatttatatttggatttactccattacataaatcccctgttccacccagcctcaatggatactggctagttctcaaatagtttttttttttttttgagaaatgcttgtttagtataagattaaatagcttctctgatcatactagaatggcaaatacgtatctgtttattaaaacaaaacctttatccactcagctgttttcctctttgctgttagaaaatgccacctttctaaaagagattataaaatagtaaaaaaggagtagggtttcagggtatggtttggaggttatcattttctagaatccatccaaagtgtttggttagaaatgatttgaactgcttgagtagtgatttgatggtaggcagtatggccgtatctccacggtataagaagactattctccaggcttgatcttcatgaactgtctatgctcagagactccagactgaaatctgcatagcatagatttctttatataacagctcaagagcttgggctatggatcagagcatgagtttgctttctagcttttgtctgttttttcatttgttaattgaggatagcagccaagttcatttggtaggaatattcaagaaggtaatgaatttatattatgtttgtcagtgcctagcacattgtagacactcaaccaaataataatcattatgaatcacatttttcagtaacctaataatatcagttattcacatcagaaaaacttgtgaaatacttcattttactgattgagaaatatttcagttccatctgaatacattttgggcttccataactaaactgaaaagtatattttattagaatgtttcataatctcaatgaatgtcaagtaacctttcagttttatcatctcaggaaaaacaaaagaacataattgaaaattatagctttaaaatgtaattttccacaaaaaaaagagaaaaaaacacgtgttaaaattataaagacatatgtaatgcactatattattctcagaaattgacattattatatgtgtttctgtaatttgaaaatattagaacttagaaagaaaaatttccgattgttacaatgctgtcattttgataataaaattatgattttaaatacattatttctcaagtgtaattcaatagagggagctccactgcttcccttttatgagcactgtaggatgcttccatttattatgattttccaatgacctctaatttaatagtgaacattattaaaaacctataattttaatattaaggatattttggaaagtgaatagtatcctctttctattcatataattcaaaaaatgcttccacaaataatatgtgttttaaagccccagttcttagttctttgtaccttttgcataataactcactagacatgattaaagtaggtatactcttgagaaacatactttaatacaccaaggcatcaaaagagaaaaaagttcatttctagtgataaaataatgcatgttttcatattaattttgtggtagctattaagttaaaactgttatatatttgaatagtagacaaaatcttttaaaattactctgcctagatttttaaccaaatggttacagatttccacatggaaatggtcttcttccttttttattttctcatatattcccttgatttaggtaatcccaaattgtattttcaagctaaattgatattcatcatcttatctattattactttaccttttaattttgttatgatgaaagaagttgttgggttgattttgttcaaaaatttataattttgtcaaaaatccactaacatggttaaaaaatttaaatggtttcaattttataagacatctcctaagatgtttctacataagggagttatccactctgtgtgtgaccctgacaattcatttaccttttatgaggttcatttttctcatggaagtattgtaccatgtgatttcttcacagctcaaaaattctaagattcaaaactatattttgatttagaagaagaatatgcacgcgcacttgtatgtttgagtcagtgttgagcaataattttacctgaagtctaattaaggaaaaaaaattcaatgatgggcctcatttttaaatttgaaatggaaatgattttattacattctatagaaaattgtataatatcacacattagacctcctaatttattactaaaattatatcagtaaatgaaatcgtccaattctctggtatatttaagaattgtcaacacagaaacagatttaaaaatctcwtattgaaattagattatctgtcacgacggccatactgggaaaggagctttgtgataaaggcctgtgggttcttcatcacagttttaacaaatcacaatttaaaataccttttaaagtaagtgcccattttattgtgcttactttccattatagatcagagtttgagaatatggtgtctgtagccaaattgtttagttttgaaacctgtgtctcctttctccagtttcccagttgggtggcattggggaagttgcttaaaccctcttctgtcctaatctatgcaatgggaataatagcacytatcttgtaggatagctgtgaaagttaaatgaattaatacacataaagttcattaaacagtgtggttgtcagtagtaagctcttaagaggtgttagtattattcaagtatttaaataaattaaatctcagttaatctttcccacttccccaaaatacgattatacacccaactgattcacatagatattatacataaagaagagaggccacaggttcagaattataaaattgccagctgtagctcctctccactctacctttctttccactcaaaaaagagaatctgaatgagagtgatgtcatgtttttatggggcgtaaccttgaatctactcactctgtaaaacaaataaaccattcacaaactccaagactttatccattaattgttagtatcatattcattatgtcatagttcccatctgttaatgaaacatcattgcattgcaatcttgaggttgaaatataaatttaaaagtgaatttgaagctaaaaatgagatgctttgcagcctatagtttacagtgtctaaaagcaattgttttaggtcattagtgtaagtaggccataggtaacttaggagtatacaagtgactgtgctcgaaagacatttatgtagactctgtagattcagagtctacacaataataaaatagggcccagtgatcatattttaagaaaccaaaagaagtaaacattttctaacatatttctcaaactttagtcccttctaatcttttctcccctctgccatcagagtgatgtaagatctgaatcaactcttttttttattgtcatattttattttactttatttttttatttattttttcttttttattattattattatactttaagttttagggtacatgtgcacaatgtgcaggttagttacatatgcatacatgtgccatgctggtgtgctgcacccattaactcgtcatttagcattaggtatgtctcctaatgctatccctcccccctcccccaaccccacaacagtccccagagtgtgatcttccccttcctgtgtccatgtgttctcattgttcaattcccatctatgagtgagaacatgcagtgtttggttttttgtccttgccatagtttactgagaatgatgatttccaatttcatccatgtccctacaaaggacatgaattcatcattttttatggctgcrtagtattccatggtgtatatgtgccacattttcttaatccagtctatcattgttggacatttgggttctttccaagtctttgctcttgtgaatagtgccacaataaacatacatgtgcatgtgtctttatagcagcatgatttatagtcctttgggtatatacccagtaatgggatggctgggtcaaatggtatttctagttctagatacctgaggactccccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctcttgcctgcataaatgtcttcttttgagaactgtctgttcatatcctttgcccactttttgatggggttgtttgtttttttcttgtaaatttgttggaattcattgtagattctggatattagccctttgtcagatgaatcaactcttataactgctctgcttcaaatacttcggacacttcccaatatagtcagggtaaaatagtaacttcttaatatagcatttaaagtttttcttacatttctcagaacaatttttcttggaattccatgtgctagccatatttctaaatgtgccatgcccttcctgcttcctgagtgggttgttattcacgtctctgtcttattcaagaacaccctttgcttcacaccctctcaatcaccctttctttgcctgaataacgtgtatccctatccttcagaacacagtttatatgccatcacctccagaaattcttccctgatctctctaaggtgcctgtcctctgtagttccagagttcatttcatgtattgcctattcattcttctctctctcccttagtgaatttttatattcctggaggcaggagctgtgtctacttaatcttttttctacccagcgtctactgatacatggtacattttcggtacacacccatgatgattgaataaatgcattagtcaaaattagatttcttagtctactgatacatagaactttctcagtacatacatgacaattgaataaaggcattagtcaaaattacatttcataattatcaatgaagcctattttaaacaacaacatataatgttgtatgaataagaaatatctacattgagaaaattgttcaatttcttttaaaaattgagggaatgacaactctcctaaaatatggtcctaaaaagaatttgccttattctacccatgctatgcaaattgagtgctaaaacaaatggaataaagttagatttcttccgagtgccaatccaagttaacataagtactcttcttgagtttccatattgaacatagtctgttcattaaatgtgagatcatcctgagaattatagaaatttatttaaactaatttattttaaaaactgtaggtttgtgaagatactaaaactactttttctcccacaggataattgtagacrtacattcaaaatagaagtaaattaatggtaatattagttcttctatttttaattaatagattaaacctttggatcacggcatttctcataatctagcagaaataatatagaaaagacttcataagcagattgatcagtcacgcaggcagtatttaacatatttgtaccactgaaaatacatctgtactgtggaccatgtcttggatgcttttgagagtaaaatattagagaaaatttggagaaaatctggttttatttttacaaaactattgactattgaaagagaactttaaaattcagtcactaacttaacaaaattatataaatttgaatgatgtttcatttttactgaaaaataaaccttgtgctcttgaaaccaacatatcattttgagaaataagtctttactgataaaaacagtgcagaattggatttatcacagatctcattattcaatggtacttaatagctgagaacttaatagttttaagtctgrtgtcacttctctggacaaaataatcttaaattcttataatctttcaacttaagtcctttttttataagctttgttttatttccttactttacttttgatccttcccagtccttcagaattttaacttctatatcatggttttactctgccaattcccatattaccttcccaatttaccttgttagtaaatttttacttctttggtctctgaggcaagctgtcttctgaattcttgcccagaaattctaagacttttctaatatattattaaaaatacttgtccagataaaccaatataaatacaacacattaccactgataactctcgtttattaaatacctgctgtactccatgtaaaatagtactttacgaaagaatggctaatatatttgtataaccaattttaagtttaaaaactgtgactcttttttaattttttaaattataaattgtaatctcactttcagccttttaaatataggactttgaatgcagtatagtttatgtatcaagaagtagccagagcaaagacattatcaaataaagccaagtaaacaagactttctctttgttgaaatatataaacctaattgggccatatcagtgatcagttaagattctggattaatcaaagaggctacatgacaattttttaaaaaatcttttctattacttgaaaaaatgtcacccatttctaagacaaatactgtctagttcctggattcttggcatgtaatctaggcttcacgttcttgatgttgtcacccaacaaaataatctttccacaaacatataaaaatatatggagttctcaattttccatggaaatagaatctagggttaatgtggtgaaataattttcattattaacaagccttattttagtatatgtaaataggattagattgaaaagccaagttttatagtaaaagatgtgatttctgtaaaagagagtattctgtaaaagctggaggacaagtgaagcttaaaggagcagcttgtactgatgagaaaggggagaggaatgagtggacctctcttcagagmggaaagaaagataagatgaaaagccagcatgaaaaggaacttgctrtttaaaattacaacaaactgtttatgtggaccagtagcatcatgatgtaaaataaattttctttactgctttgccatgacgcttaattgataatacattctagtaagcccaaatttgaatctcttctcgataactaacattcagttaatttcttatttcgaagtgggaagagcaatggctggaaagaaacttcctacagagaaattctgatgcaaatatgtcttgaaatccagagcattttggtccaaatttaacaatgtgtgtcaaattttacaacagcagatgtgaatttatggttctttattaagttttaggaattctgaattgtatttgtctgcttaattctatagtgaaactaaagctcagttaaatagtctaaagaatgttacttaatagtaaaattacataaatatgccatgcacatgttggctttcaacagagtgcatttgaatatattcagatctgtggtgggtgctgaagacttgtctatataggttcagttccataactgaamcagtgagaatctagaaaaccagtgttttcaaaactactccctcatgggtgaatggagcacatactattgaatgatctgctctaaacttaggcattggtgggcctgaaataagacttgggcagtgagcatctgcttctcttcacccaaagagttgaccttccaagactatagaggaagttaaaattaagaaatgagtataagagagacacaagtaggtgacttctcaaattctgaaaagggaagtttgggtaaacaaatctgaaggaagaagaaattaatattagaaaagcagagttaggaagacagaagtgaatcagtaaaatgtcttttgttagaacaggtgcttctacatctgttttgaatcaactgcacaatggtttatgcatgggccaactgaatagaaatactcaaggctggcataaatggatttggttccagttacagatttctttgttttgttttgttttcaaaaatagagcccaattaaatccatcctcattggttgtagacattaccctaaatgtctagtgtgtgcaaatgtttctctataccctaccttcctatccctattccccatgggtccctagcattagaccctgcttcctgacagtctagacttgggcttgtcattataccaccataaattagaccctgcttcctgacagtctagacttgggcttgtcattataccaccataaatatatatatatatatctgtaattgtttccttagtgaattgaaggttttttcatttaaaattaaatttgtgtggaaagtatattctttcccatcaagttaggaatatttaaaagaagtatacatgttagatgcaaagcgctaattcaggaatgaccagataactagtatcattatattctttttccaagtatattccccaatgtttggaatgctgttcttttgatcttaactctttcatctgaaagcacccatcaaaggttacatgagcaaattacccaataaatgttatttttccaatagtttcagcctcaccctacttaaaattatattgaatgttcgtgacagttcaaattgacaaattttcagtttgcctcttctttttaccccacgttattctccaaatagaaatcttgagattttttccacaagataaatctttagaataactgaggactaattatatgttccacagcagtctgtagtagtctcacaggctgagcgtccaaatgaggttgctgctatagggaagggcaggcggaaatagaaataaaataaataatccttcccaccctcacacacacacacacacactcacacacacaatcaagaaaccatcaaacaaagctcagaaacatttcaaacataagatcatcttttactttacttttttgttgcatgtttactttgccttctggaaatattgcacaatctattagctttttctctttagatgtttgaaggatacagaaggtactactaacttaaaaaaaaaaacattgattctcacagcagaacctgtgtgtacttgttcactacatacctacattgttaaatatagttgcttcacaaacaatacaataagaaagaatttaagaaaacagattctatgtaaatagtctgcgtcactaactctattatttagtgattaaacggaaaaatatttagtattgagtgttggttcatcattgttgaatcagtaacggttaccaggatcattgtcaagttaataattgagaccaggaacttccttcttgctgagggcttttagtagtgatcagtggcagagggatatgaaaggctggagaagaaaacaggagacccagtcctgcctttaccagcagccctgagattttggttaatcacttcatatttctgttctgcttctttgcttatacaatgacattaggctacagctgagtgggctcccttccgtgtggttgtgagactttattctactgccaaataaaaataatatttgcattatctctttttttaatatttgcacttttttgttctcatcagtatccataatgaagcactaagcatgtaacattttgcagattgagatttcccagtcaccatgcaccataaataaaataattgagacataggaataaaaatgcattacagtataaacaagcagtaacagagtgtggaaaataaaaagacaaggaagtacaacctctcctctgtttaacactgaacaaaatttttgggagagtataatgttatatttataaatagagcaattagatttggttcagagaaaagaaaatgattaaacctatagaatacagttgttgtaaagaagggaaaagacctggagaaggaagaagtaaaaggtgaattaatagctgtgatgagaacactgatccatgattcttcatctccacagacgactgtcccacaacaaaaacaaaacagcatgcaattgctgaaggaaaaagctagttcctcaaatttgaaatgctacttttgaggaagactcagggacttctacctcttagagtattacaaaatgttatacatataccatactccaagcagagatgttctgctgtctctttaaacttagtttagtataaaaggatggtaaatttggtgataaatttagtaataaatgcaacatttttcttatctgtaacttaataggaataaactaatttaagattccttctgtttcaaattctttatgattttttattttggggatgttggacttgaagcttcactaaatattcggttatagaaatacttttctaggaaaacttattagggttaagaaaccagatatttttcttttaaaaaatatgtaattcatatattttgaacttaataattakattccaaatggtcctaatcacaccctgtggatctttagctcttgaggattcaaaactatgagattttacaatcacgttttagatagtaaagattgaatgagtatgttaaggctttcatgaaagaaaaatggaagaaagaataattgaaacaagtaacttaagtggtgggcaagtaaaatctgtaagccaatttctttgtctgtaaaatgaggagaataataggatttatatgaattttttgttgaaagaacaaagttagataatttttggaaaattattagccaagtgaatggccagtagaacagacttcaaaaatgttagctatttttttttttccccaaaaaaatgggaaggtatggtgtacttaatatggccaatattgcccctttcaaccaaaaaaagggaaaaatttttgttttgtaaaaaattatccccccaccaatttttttatccctttttttttaaaaaaccgggttgaagttaaaaaaaaaaattcccccaaacagtgtgtgggatgttttctttaaacggaatgtgttttttaaccccccaaacccaaaacccccttggaaggttaaaaaaaaaaaggttttttttttttttttttttttttttctaaaaaacacacaggaaccttaataatgggcttctctgaaagggaggcctgcgaatatgagataggagggaagccttcttattttttaagtatatgctttatctgatttgaatatttataatgtgtacattattttaaaataaactactagtgcaaaattagtattattttttattttttacatttaattttattttaagttccaggatacatgtgcaggatgtgcagatttgttaaataggtaaatgtgtggcatggtgatttgctgcacctatcaacacatcatctaggtattaagtcttgcatgcattagctgtttatcctgattctgtccctcccccctaccccctcaacaggtcccattgtgtgttgtccccctccctgtgtccatgtgttcttattgttcagctcccacttttaagtaagaacatgtgatgtttggctttctgttcctgcattactttcctaaggataatggcttcccacttcatccatgtccctgcaaaagacattatctcattcctttttatggctgcatagtattccattgtatgtatgtaccacattttctttatccagcctatcattgataggcatttaggttgattccatgtctttgctactgtgaatagtgctgcaatgatcatacctgtgcatgtatctttataaacagaatgatgtctattcccgtgggtgtatacccagtaatgggatggctgggtcaaatggtatttatggttctaggtctgagaggaatcaccacactgtcttccacaatgattgaactaatttacattaccaccaacagtgtaaaagcattcctatttctccatagccttgccagcatctgcagcatctgttgtttcttgattttttaataatcgccattctgactgggatgaaatggtatctcattgtggttttgatttgcatttctctaatgattagtgactttgagctttgtttatatatgtttgttggctgcataaatgtcttcttttgagaactatctcttcatatcctttgcccactttttaatggggttgttgggtttttttcttgtaaatttctttaagttccttgcagaccctggatattagacatttgtcagatggatagattgcaaaaattttctcccattctgtaggttgcctgttcactctgataatagtttctttgctgtgcagaagctgttcagtttacttagatcccatttgtcaatttttgtctttgttgccactgcttttgatgttttgtcatgaaatctttgcccatgcctatgtcctgaatggtattgcctagattttcttctagggtttttgtagttttgtgttttacatttaatgctttatcatcttgagttaattttgtctgatgtataaggaaggggtccagttttaattttctgcgtatggctagccagttttcccagcaccatttattaaataaggaatcctttcctcattgtttgtttttgtcaggtttgtcgaagagcagatggttgtagatgtgtggtgttatttctgaggcttctgttctgttccattggtctatgtatctattttggtacctgtaccatgctgttttgcttactgtagccttgtagtgtagtttgaagtcaagcagcatgatgcctccagctttgttctttttgcttaggattatcttggctatatgggcacttttttggttccatatgaagtttaaagtagtttttttctaattctgtgaagaaagtcagtggtagcttgatggtaatagcattgaatctacaaattactttgggcggtatggccattttcactatactgattcttcctatccatgagcatggaatgtttttccatttgtttgcgtcctttcttatttccttgagaagtggtttgtagttgtccttgaagaggtccttcacatcccttgtgtgttgtattcctaggtattttactctctttgtagaaattgtgaatgggagttcattcatgatttggttctctgcttgtctattgttggtgtataggaatgctgcttatttttgtacattgattttgtatcctgagactttgctgaggttgcttatcagctttggggctaagatgatggagttttctagatataggatcatgtcatctgcaaagagagacagttttacttcctctcttcctatttgaatatcttttatttctttctcttgcctgatttccctggccagaacttccagtactatgttgaataggagtggtgagagagggcatccttatattgtgtcggttttcaaggggaatgcttccagcttttgcccattcagtgggatattggctatgggtttgtgataaatggctcttattattttgaagtatgttccttcaatacctgatttattgaagggatgctgaattttatcaaaggctttctctgcatctattgagataattattgtggtttttttcctttagttctgtttatgtgatgaattacattgattgttttatgtatgttgaaccagccttgcatctggggatgaagccaacttgattgtggtggataagctttttgatgtgctgctggatcagtatgccagtgttttattgatgatttttacatcagtgttcttcagggatattggcctgaagttttcctcttttgtatttctgccaggttttggtatcacgataatgctggtctcacaaaatgagttaggaagaagtccctgtctttcagtttttggaatagtttcagaagaaatggtatcagctcctctttgtaccttcggtagaattcagctgtaaatccttctggtcctggtctttttttttgtttggtaggctatttattgctgcctcaatttcagaacttactattggtctattcagggattccacttcttcctggtttagtcttggggtggtgtaygtatccaagaatttttccttttcttctagattttctagtttatttgcataacggtgtttattgtattctctgatcgttgtttgtatttctgtgggttcagtggtgatatctcctttatcattttttattatgtctgtttgattgttctctctttttttctttattagtctagctagcaggctattttattattataattattatttaaaaaaaatagctcgtagattcattgatttttttgaagggtttttttatgcctctatctcctttaattctgctctgatcttgtttatttcttgccttctgctagtttctgggtttgtttgctttgggttctccaattctttcagttgtgatgttaggtttatgatttgagatctttctaactttttgatttgggcatttagtgctataaatttacctcttaacactgctttagctgtgtcccagagattctggtacactgtctctttgttctcattggtttcaaagatcatcttgatttgtgccttaatttcattatttacccaggagtcattcaggagcaggttgttcaatttccatgtagttgtgtgattttgagtgagtttcttgatcttgagttctagtttgattgtagtgcaaaattattgtaacaacagtattactaccaaaattgtagacaagatacatcttctcacatagtaatttatttattatgaattgagaaattaggaattttggttatagttcctatgaaactttaggataacagttgtgctcatttttatgtgttgcttgtttcttttccccgttaggcttgcgaatttttttcttatttgttacaataaacctacaaacatattgaaattaaaatgatctttcatttttattgccattcttatattagtctatgtttaagttaaatcacatttaagatgaagttgcatagtttgcttcttgattgatgttttgaagtgatttgcaaatgtaacaatgtaagcytagaggatatctactaaaaaaaaaatcacccaaacatacagttaacagaagtgcaaatattcttcagtagaaataaatttatacatgttatggcgagcaagtatgagaagaaaacataccataagaggaatttaaattttgtatcaataattttttgacactcaagattgttgaaccacacttaatacaatggattattttaaaagctgtggcatagtatttctggagaagtatttcctaaattcttgtgatccagataattagaccacaaccaaattaattttataatggcatatacttatactcactcttagaattcacaatagaaatgagctttgctaactcctggtataaagaaattgtttacattgtttaaccttatgtctgacttgagacatttggaaaaccagcatttggaaagcagtgttttgaagtaaaatatactacatgaatgaaatacagtgtctagatttaggactatttgatgtctggtaccttctataaccataattcttcattataagtcaaaatacaacagaagaacaaaacaaataaatacaaaaagccctattatttatttccatgaagatacatgtaagttttccacatgatttggaatttatattatctaaatttttattttaagctcactcaaatatagataattgcaaatttggaaaagcagtcagtaatatcaaaatactgttattttgtgcctgtgtatttttacaaaatatttcgagtccattctttcaagaggttcacatcagtattcaagtactatggtactttcactagtagccaagtactatagtactttgactaagtatggtaacagcctgtaagcctcctaaagctgaaaagattaaaattttattcttagacaattgaatccactaatacaaaataatttaaagtaatcggttaattttgtttacttcgcattttactttgctatgtgtttccctgacatatgactcactacctatgtatgtctgtgtctgagaaggacatacatagctacgcggaagggacatgcgagggatgagggaagcataggcatgttgaggtacttatctcctgcagagcaaacacgtcatgatctggaaatgactgcatttcctcccacgtgcctaggcttttctgaatccctggttctcttttcaacaggcccatagaaatgtctctgcttctttgttgttatttacatttaccaaaactgcagggatttccttagatgccttccagctagtctggctttataaatcagacctatgtcccaaaggaattttaacaagttttcactatttttgggaaaacacaggacatgtaatatattccataaactactcctgaaaatatttttttaatttcagagttaaattgtgtttagtactacacaactccaattttctcctgcaatctatagatttattgacatctgcaaaattgtttaggcagaaaggtggtttctttttccattttaatattaactgcagccataaaacaagcatggcaaaccaatgactatattttgggaaattttttagataattcagtagcttacacaaattgcctttgttttttctgagcctattatagcagacctgtaaggtttggttgtatatattcattttttctactaatgtggaaagtagttgtagttttataattggtgaaataaaatgcaagcaaggtaataatgactgtatttcacggagtaatttctaactttataactgtaagcacagtaaataaagcatgtacctcatgccataaacttattctcaaagtttatcttaagttaatcaacatgtatgatttgacttttcatcaaatgaccgccctgccaacttattaacaaaggatttctggtattaaaattttttggcagttattttgggcctttcaagatctttccattaaaatatatatttagtgaccacaatggaatatgtttttactcttcaggttgtacaatcttcaatgcaactttttcaggaggatgtttcatacagtgtcactgtaatcctataaagtataatatgaagattcaagagttttttgtccttggagagtacacagaaatagagaaattcacagcaacaaatgagctcttatttcttatatccagagatgttttcttactaaattgttatgtatgtatactcatgtgacatattttttctatttgatgtcaagtgattcttttacatcagctctccattttagattattcccatgaaaatatgcttttcttttactattaagttaaaagcaattaattcaatatgacttatgacaccatgttatttaggatatcttattgcaatgacaggaatcaacaggatctagcttaagcaaatatgggggatatataacgagggaacaagaagtctctgtaacagagctatagtaagatatgcatctctataatgaagctaggacttagatctcaagaacgaatttaaattaagggcatgaaggctatcagttctgtctgtctcaattcctcagctcttctttcttttcatttgccttctctctttctgaagactatcccattttgattctaaggccatatggcagcccatgtctcctggattgagttctcctccatttaataaacatagtttgcctagttctgaattcacagggcaaggtttctgattggcttagcttgggtcaggtgtccatttaggaccagtcaactaacattggaggaggggaatttgataggtttctgtgcaatttcaagaagccttgggatgtgctaataaagtagactgggcaagcacaataataactgcctactatagcattttttgcttaattaaattaatatttattagacactcatcataagcaagttataaccgtggtgctgaataaatgagtaaaatactgtatctatattcaacaattcaaggatgtggctgctgtgcaaatcattggagtacagtgaagacagagaatggagcttagtgatgatcataaggagagaaataggaggtttaggagctaggaggtatgatcttcctgagaatctttgaaatagaagagacctgaatatctgtgggagccaaaaggaaagaaggatcagactcaaagggcaaaactgaacttggaaaagcacagggattgattgggcaatgtctcaaatctggagaaagagacaaaactgagaaacgggacaagattactagaaacttactggacttcttcctaaaaggtagaaacaaaggatgaacaaaagcattagtacaaattgagtttttaagtagaattaatttctagtagatttaatgaagttttggacattcttcagcaatatctactatctaacagtaaaaatattgtggaaccatagcttccctactgcccagtcctctgtctgtccttgatgttcatggtgtcagcgattattgggatggttaactctgcaagtagtatttaggaaaaagtgattgccctcttaaaggttaccatacctttccaaagaccatagcctctggattcatttcttagcagttttatagttcctttgttaaatgttagcatgtgagatagtaatttttcataaaaagcatatgtatacttttaggtggcatgaaagtgttaactatctgtggacttttatccaatttcagcttatggtgacaggtttcctattgtagatgaattgaattaatttttcaaaataacctttttttgcgaggctatatcaattggtgtgctacagttaaaatgtattactttgcctatttcccattttctactaaagtttataattcacacaaagaaatacaataaagtgtgtctcctgaaattgtgctttgtgaaatgatgaggccattactctgccttttgagattaataaatttttctcttggcatttgttcccttatctaactggcaatgtgagtttaagctttacagataaatattatactattgttttaagttttgatttttgtttattccttataaacattacttttgaaaaataaagtgtatcttctgcaagttgtacacatgtatatatgaagtaaacctagtcaaagtgcttgagttgctttgtaattcaaaattatgtaagtacattatgttatgttgaataacaaaaagtgataactctaagtttaaatgggtgactaaatttaaaaaataatttataccaagtatagagataatagatttaaacatatcaatttaaacttatagctatcacttcttgttatttaacataacataatatattcatgaataggtagtagattccatttttcatgatcaagctttcctcaaataaccctccctccaattttcaataacaacgaaacacaacaaattaaccactcatccagaaattctaaactatttacgtataatgattgtcacatacctttttaaagaacactttgttttccaaatataatttgactaaatgcaaataagaactgaaccaataaaatgaagcttttaaaaaaattgaacttctgtttgataaatggaattatttatttgacaacactaaaaatatgtaaaataatgctttagaatatcattttaaatccactttttaataaaagctttcttaactaattaattcaacaaatatttgttgagtgactaccatgggttagctactgtgttaagttggatgctagggatgcagtgataaagaaaacatggtcctatgaagcttttgttttggtggaatggtggttcttaaacttgcacgtgcctctcaatcacctggagagtttgttaaaacataggttgttgggcttgacatctacagtttcagattcagtatttctgaagtggggttccaaatttgcatttctaacaaggtcccatatgttgctgatgttgccagtcctgggaccacactttgagaacagctgtcctagaggaggcagtgctgtctatataccaaaacttcaattagcctatgctgtgctgacccatgcatgcccactgcagctccccctctttcattttttttcagaagaaaaaatgctttctgtaaatacaatctggtatgtggatagtgcacaaattatatagttgcttcttaaattactgagaaatttacgaggtcaagtaaatataattttcagagataatgctaccttatttagcctagtgaaaatgtatcatcagtattatggcctgattttcaatttaatcatcactttattttaacataaagcttttctttctgatcttttggtagccatccagttttccatagtcttttaaatgtgatggccagtggttcatttattgcaataattaagatggatagcagcatgccagctggaatgactacacttgtgtttattgtataaattatttccttagtataaaagcctcttttatggcttttgctttggtcatatcttttgtaccctaaaccattaaccatagcatgtttaggagagccatttataaagaagctggtaatatttaccaatttctaatcaccattaattcatgtctacatttttcttagcactggagattgcttgttgctttgttccttctgccaagagcaagaaaaaaaaagtgttctaacccttctaggactcataagcttttttttttccttttcttccttttctttgatttttttttactacattcacacttcttttattttgttctactctcatctcttttccttgtgaatcttaagttactttggttagtttactcaaaatacatagaaatgcagcccctaatgtgaatttcttataaggcatatttgaaattcctttaaaacacagactgcaactgatttttgtcatttttttaaaatgctacttgagtttggtggtcttttgcatttcaaaaataattgcatttcagttttaacagaaattattcagatatagttcagacactgatcatttctgtatgcatcatcgtacccagcaaatttcagtaaatatttgctgacctattttttttctttacactttagtttcaaggaaattgcatgcctgttacctttctaaaagctagtgcagtgattgttggtatatttacaatactcatctttccttttaaactttgtaagtttgaaagtataaatcaaaatgtcatattacatcagaatataaattttattattacccatatatcaaataactagttaaagcaattcagagtagttaagagggaatatttagtggcaataaatgtatattgttgcatataaatacacatattaggcctagatttattgtctacaattcttttaatttcttatcagatttcagtatgaaaaaaagtgaatgaaataagcaaaagactatatccagttactgtaactaatgctaatttcataatctcttaatggtttaatgttatatcctgatggttttatgttttttgaccaatctttcaggctatccttttctgaccactcaaaccatgaaaacctgccctccctggaaaatccaagagccagtcagttcccacaaagacaacaagagccactctgtttggaaaactttggctctttttcagcagtcaccattggccttagaatacagagcattcttacccactggctaagattaacttggttagcagacagcctacatcccttcgtataaaaactgttcttaaaaagtagcaaacattgtcctaaatttccttaccccatccctgactatcatcacctactttctgtcactgacttgttaatacctttattgttatatacagattttataagttgtccctacctgtttttaaataattgaggttataagcataatagttggaagggttaactacgttgtcctgttaaggctgataaaagggcatagatgcttttaaacatacacaggaagaatgagaaaagcagatagcccttgtttgggtcattaagaagatgataaagtatttttcttatagcatgtttgtgggtaaagtatttgaaagcttctaatctgccattgataaaacagatactttactattaggttttgaaaaatgccttaaaaaaatctgctgcaaacatcatttaatatgtcatttaacttataaataataagcagaaacctaatatcttcatttttgcaggtatgaaatattgtaaaagaaatgtaaaataaattttaattttattcattgatactgtgaaggagaactttaatagactgagcataatgtatcatttgcatttatataatgattttaccactgtcattttagaatactataaatttagaagagtaatacagtaataataagaatttttaacattttttagtctcaggttcagagatgagtaaaagaccctcaggacatacgtaaagagaagaactctttctagacagaagtgaagaaatactaaacactcaagtgtaagattccctgaagatggaatgatggtagttgtgttggaagtggtggtgggatttgttggttgagggaagagaagagaaactaatctattgttcagagatggggttaagtagaccagggattagatttctactcagttaccagctagtcatttgccgttgagaaagttacatcagtctttggatactttaattcccatctgtaaaatggggaaggtaatacctgttttataaagttagtggcataattaaattttaaaaatgtgtattaaagcattttgtacacaaagtaggcactcaagaatcgaactattactaaagactcttactattaaagaaaagcaaaactgtattataaaggaaaagcaaacaaactctggacaatcagaattataccagaagtgtattttccatggaagttgaacctagattagtgcataacaaggaactgctacaggcattgatcgtttcttagaaattggctactgattccacaaggaacacccacaccttagtagctgatgatccccttttgtgtggaatagaaataaatgtaagtagacaataaataaaaactgaaattatgtactgtctctgtaatttacgtctagtatttgaaagatcaccactgaatcttacgaattttgctgactcctatacacaactacttgggaagtttccttaggggctgagacacaggagcagcacagtagaggagcagtacaaaatgttcaggagaagataatagtcagatagcattgtcacaagaaatacgctgtattttccactaagctcatggttgctctcagtgcggttgtttattcattcattcatccagtaaatttttatcaagtgtttatatgttatcagcatggaactaccaacacctgaaaatacaataatcactaagatagatagagtccttgcctttgtagaacttgtagtatgtctaaaatttgttttaaatcattctgactcttttagaaagacttcttcatattaagttgaagaagttgagtaaagttgccacccccatagtatagcccttttaatgaccccgtctttctcattattaaggaatgtccatgtgacttaggtgttctgaagcaaagtaaactcctctagactagtggttttcaaccctgactgcacttaggatcatcttggaagttttgaaaatatgaataattgagtctaaccacagacaatgaaataagaatttctagacttggggctcaggcattagtattgtttaaaagctttagaagtgattctaatgtgtagccatgattgcaaacgactgcttgaaaaaaacagagaagaaaaatagcaacttggggtagtgaatgatgacaaacaggaagcaaagtgagtgatagaaataacaatcatgaagctttaccaaacatccccatcatagatgtcaagataaggcttatacagaaagtaaataaaacagcttactcttagataatatagtgatttcatttatactcaatggaaatattccatcaagaaatgtgccaaatctagatactttgtcatattattagaaatgtcgatattgcaactagaagatgttggataggaggcaggactagcttgtggctcccactcagacagacagagcagtgtgtggagattcattgtgaaccattgctccaagaactacagcaggaacataccaggaaagcagagagaatccacagaccctttgaaggaactgtatcactgctgcaggctccatgagatgctgaaaaactgtgagtcagcttgctttctcaatggggagtctcgtggtttggggcaaattctcagccctggtcacctgctgcatagaaatagactcggtgctgttggtggggcatggtgggagtgagaccggcctttaggtgtgcaggctgcatgggagcggggtgtggcccgtgactgctggctttctcccacttccttggagacctgtatgactcagcagaggcagccataatcccccttggaatgtaactccattggagttataactgcacccccatcccccatggcagccacagcaagctctgcccaggagaggctgagttcagacacgtctatccctgcccctacctagtggtcatcctctgcctgcccaggtagccaaagacaaagatcataatctcctgggagccctatagccctgcccaccgtctgagaaacctgaatacttaaccaggtgtccctagggcaagtttgcatcttctctataggattgcagctgatgcgcttytttttttttttttttttttcttaaacrgagttttgctcttgttgcccaggctggagtgcaattgtgcaatctcagctcattgcaacctcttcttcctgggttcaagtgatactcctgcctcagcctcccaagtagctgggattgcagatgccygccaccacgcccagccaatttttgtattttcagtagagacggggtttycccatgttggccaggctggtctcgaattcctgaccttaggtgatccacccacctcagcctcccacagtgccgggattacaggtgtgaaccgccacacccagctctgatgtgctcttgaaagcatcaccttctggctggaggccaacaaacacaaaatcagtgcactaaataaaaacacaaccagggacccttatggtgtccacttcactcccctgataccttcaccrgagcaggctgcgagacctgaaaacggatcacatcacaagactcattgcagacactccccagtaccagcctaagctggtagctccactgggttgccagacctagaagagcaaaaacaatcatgacggtttggctctcaggaagccccactcctaggagaagggggagaacaccacatcaagggagcaccctgtgggacaaaagaatctgaacaacagcccttgaatcccagatctgccgtctgacatagtctacaccaacgaaaaggaatcagaaaaacaattctggtaatacgacaaaagaggtttcttcaacaccccaaaaagatcatatcagctcaccagcaatggatccaaaccaagacaaaattctctgaattgccagaaaaagaatttagaaggttgattattaagctaatccaggagccaccagagaaaagtgaagtccaacttaatgaaataaaaaacatgatacaggatatgaaaggaaaattcttcagtgaaatagatagcataaataaaaaacaatcacaacttctagaaatcaaggacacacttagagaaatgcaaaatgtactagaaagtatcagcaatagaattgaacaagcagaagacggaacttcagagctcaaagacaagtcttttgaattaacccaatctgtcaaaaacaaagaaaaagaatggaaaaaaaatgaacaaagcctcgaagaagtttgggactatgttcaacatccaaacctaagaataattggtgatcctgaggaagaagagaaatctaaaagtattgaaaacatatttgagggaataattaaggaaaacttccctggaattgctagagatctagacatccaaagatgagaagctcaaagaacacctgggaaattcgttgcaaaaagatcattgactaggcatgtagtcatcgttatctagtcaagacaaaagaaagaatcttaagagctgtgaggcaaaagcatcaggtaacctacaaaggaaaacctatcagattaacagcacatttctcagcagaaaccctacaaggtagaagggattggggtcctatttttagcctcctaaacaaaacaattatcagccaagaattttgtatccagtgaaactaagcttcataaatgaaggaaagatacagttgttyccagacaaacaaatgctaagagaatttgccactaccaagccagcactacaaaaactgctaaaaggagctctaaatcctgaaacaaatcctcaatatacacaaaatagaacctccctaaagcataaatctcacaggacctatataacaataacacaatgaaaaaaaaaaacaaggtatttaggaaaaaaamtagcacgatgaatagaatggtacctcatatctcaatactaacattgaatgtaaatgacctaaatgctccacttaaaagatgcagaatgacagaatggataagaagtcaccaaccaagtttctgctatcttcaggagactcacctaacacataatgattcacataaacttatgataaaggtgtggaaaaagatattccgcaaatggacgctaaaagcaagcaggattagctgttcttatgtcagacgaaacaaactttaaagcaacagcagttaaaaaagacaaagagggggcccagtggggtggctcatacctgtaatcccaacactttgggagaccgaggcaggcagaccacttgaggtcgggaattcgagaccagcctgaccaacatggagaaaccttgtctctactaaaaatacaaaattagctgggcgtggtggcacatgcctgtaatcccagctacttggcaggctaaggcaggagaatcgcttgaacctgggaggtggaggttgcagtgaaccaagatcatactattgcactccagcctggacaacaagagcaaaacttcgtctcaaaaaaaaaaaaaaaaaaaaaaaaaaagacaaagagggacattatataatgataaaaggactagaccaacaggaaaataccccaattctaaatacatatgcacctaagagttctcaaatttataaaacaattactaccagacctaagaaatgagatcgatgacaacacaataatagtgacggactttaatactccactgacagcaccagacaggtcatcaagacagaacgtcaacaaagacacaatggacttaaactatactttataacaaatggacttaacagatatttacagaacattctacccaacaactgcagaatatacattctattcatcagcacatggaacattctccaagacagatgatataataggccacaaaacaagtctcagtaaatttaagaaaaccaaaattatatcatgtactctctcagaccacagtggagtaaaattggaaatcaattccaaagggaaccctcaaagccatgcaaatacatggaaattaaataacttgctcctccatgatcattgcatcaacaataaaatcaagatggaaatttaaaaattcatttaattgaatgataatagtgacactgttcccggaccaaactgagggttgggctgttatttctcacagccccataatgagatgcagataaactggggaggaagagagtttttatttctgtamccggttacagggagaagacctggaaattatcactagaccaattcaaaattataaagttttccagagcttatatactttctaggctatatgtctatgtgtaagtgtgcattcgcctaaagacacagtgatcaacttcttttaatctgtaactaaggtctgagtcctgaagaccttgctctggagcctcagtaaatgtcttacttaatctacatgggtccagatactggggtaattacccttatcttgtctcctgctaaatcatggaggtttgaggagttcttcagacccccaataaacttgtttgtggaggtctgggaagtttctttagacccacaataaaactttagtcctaaatgggtcctattaagaattccttcgttattttgtcatgctttaaggcccaggaaaggcctaggcaaaactcctgatgggctttttgttacatcccagccattgtataagggcactggcttttaatatttaacttaaccactcagtcagtactgaaacagctgttagtgagagctgacctaccacaacacaacctatcaaaacctccgggaaacagcaaaagtggtgctaagaggaaagttcatagcattaaatgcctacattggaaagtttgaaaaagcacaaatagacaatctaaagtcacaccttatggaactggaggaacaaaaacaatccaaattcaaactcagccgaagaaaagaaataactaagatcagaacacaactaaatgaaatttaaacgacaacaacaacaaaaaacaataaaaagataaatgaaaaaaaaaaactggttctttgaaaaggtaaataaaactgatagatcattagcaagattaaccaagaaaaggagacagaaaatccaaataagctcaattacaaatgaaacgggagatattgcaactgacaccacagaaatacaaaaggtcattcaagacgactatgaacacctttacgcacataaactagaaaatgtagaggagaygaataaattcctggaaacatacaaccctcctatattaaaccaggaagatacagaatctctgaacagaccaataacaagcaacaagactgaaatggtaataaaaagaaaatgccaacaaaaaaaagtccaggaccagatggattcacagctgaattctattagacattcaaagaattggcaccaatcctaataacactattccaaaagatagagaaagagggaatcctccctaaatccttctgtgaagtcactatcaccctaataccaaaaccagagaaggacataacaacaacagcaacaacaacaaaaaaaaacaacagatcagtatccctaatgaacatagatgcaaaaatcctaaacaaaatgctagcaaaccaattccaacagcatatcaaaaagatagtccaccaagattaagtgggtttcataccagggatgcagggattgtttaacatacataagtcaatagatgcgatacaccacataaacagaattaacaacaaaaatcacatgatcatctcaatagatgcagaaaaggcatttgacaaaattcagtatccctttattattaaagccctcagcaaaattggcagagaagggatataccttaaggtaatgaaagccatctatgacaaacccacagccaacatcatactgaatgggaaaagttgaaagcattcccccagataactggaacaagataaggatgcccactttcaccacttcttttcaacacaatactggaagtcctattcagagcaatcagataagagaaagaaataaagggcatccgaagaggaagtcaaactgtcactgtgtgctgatgatatggttatatatctagaaaatcctaaagacttattaagatcctagaactggtaaatgaattcagcaaagtttcaggatacaaaattaatgtacacaaatcagtagctctgctatatactaacagtgactaggctgagaatcaaatcaagaactcaacctgatttacaatagctgcaaaaaataaaataaaatgcttaagaatatacctaactaaggacgtgaaagaccttacaaagaaaactacaaaacactgctgaaagaaataatacatgacacaaacaaatgaaaacacaccccatgctcatggttgggtagaaacaatatggtgaaaatgaccatactgccaaaagcaatttacaaattcaatgcaattcccatcaaaaataccaccattattcttcacagaactagaaaaaaaaacttaaaattcatatgaaacaaaaaaagagcccacatagccaaagcaaaaagaacaaatctggaggcatcacattaccctacttcaaactgtactataaggccatagtcaccaaaacagcatgatacgggtataaaaataggcacatagaacaatggaacagaatagaaaacccagaaataaacccaaatatttacatccaactgatctttgacagagcaaacaaaaacataaggtggggaaaggacaccctattcaacaaatggtgctgggataattggcaagccacatgtrgaagaatgaaactggattctcatcttaccttatacaaaaatcaactcaagatggatcaaagacttaaatctaagacctgaatctatacagattctacaaggtaacataagaaaaayctctctagacattgagttaggcaaagacatcaagaccaagaatccaaaagcaaatgcaacaaaaacaaaggtaaatagttggtacttaattaaactaaaaagcttttgcacarcaaaaggaacagtcagcagagtaaacagacaacccactgagtaggagaaactcttcacaatctgtacatctgacaaaggactaatatccagaatctacaaagaattcaaataaatcagcaagaaaaaaaacaattccatcaaaaagcgggctaaggagatgaatagataattctcaaaagaagatgtacaattgaccaatgagcataaggaaaaaagctcaacatcactaattatcagggaaatgcaaatcaaaaccacagtgcagtaccacctcactcctgaagaatgaccataatcaaaaaattaaaaaataattgatgttggaatggatgcagtgaaaagggaacagttttatgctgttggagggaatgtaaactagtacaaccactatggaaaaacaatgtggagattccttaaaaactaaaagtagatctactatttgatccagcaatcccgccactaggtatctacccagaggaaaagaagtcatatgaaaaagatacttgcacatgcatgtttatagcagcacaatttacaattgcaaaaatatgggaccagttcaaatgtccatcagtcaatgagtggataaagaaaatgtgacatatatatatacacacacaccatggaatgctactcagccataaaaaggaaggaaataatgatattcacagcaacctgtatagaattggagactatcattcgaagttaagtaactcaagaatggaaaaccaagcatcatatattttcactcatatgtgggagctaagctataagggtgcaaaggcataagaatgacgcattggactttggtgactcaggagaaaggctggggaatggcaagggataaaggatgacacattaggtacagtgtacactgctcaggtgatgggcacagcaaactctcagaaatcaccactgaacaacttactcatgtaaccaaacaccacctgttccccaaaacctatagaaattaaaaaaaaattaaaaagaaaagaaatttcctgtcctaacaatcaatgaattattttatcatatattgccaataggagctaaacaacgagtttgggccagattgatctgtattttctaatatactttattttttagagatgttttatattcacaccaaaattcaacaaaaggtacaaaaatttcctatatatccccttttgcaacatgtgcatagccttctccattatcaacatgctccatgagagaggtactttgttacaactgatgaccccagcgttgacacattattatcacccatgatccatagcttacattagggttcacgcttgctgttgtacattctgtgagtttgggaaaatgtatcatgacatttattcctatctttaaaaataggagtaccaaccggaacttgaatttggcccttgtatctttacagtgctggttttattttactctcatagtcatcttttgatgctgtaacggaaccacctgactacccatactatttgcaggttgtctccaagattgccaatatgggtcacccagaattagcacaatgggaaaggcaggttggctaggccaccttaataaccacaaagacaaattgtcttaaattagaggaaaaaaggtagtgtctaccaagacatctaccgtaaaatctatctgaaaattagaattggtttaaggtgaagtaagtcagaagagttaatgtccatttcttgttcatgtacgtgtgtatgcttgagtctttatgtagtaccactcttgatgtttatgtagttatgtggtactacataaatactcaaacatatacacatacatgaaccaccatgtaataccaccgtattgtctgtatctccggggatataggctttgctaacttgttttatgatccactgttgatacatttgtaaatctaaatgctaactcatttattctgtttacctttccgaggcaggcaggttcaattgacttaacagcaggctagcaactcagagactgtgaaatctaatcacattttgacccattcttaaattgcttcatctgtgaaaaaatgtttgatgaatgcagtactctcttgtgagggtttgtatgaagaataaatattagaaatgattgtggggcactttgaaaatttgttatgaaatgataattatattcaaaacaccctttgacatcaacttacagaggaaaaagtgtaatttttcccattgtagacctttttaaggaattccatatttggtttatccctagaattttctatacttgtgtataccatacttctcctaacccattaatggagttgttaaacatcatataatattgaaagatatttctattagatgagctttcaattattaatggtaatggaaraacattaatgcagctcttacaacatgacagactgtcagaaagatctcaggaatagtgaagggccagagatcctagagtccctgatctgtataaatttgctgcagtatctttataaagtggataataattgtgttagagatcatttgatcagggagaacccagctcaactgtgcaattcagaagagctgggagttaggaggaggttatcctcaatatattaaggcattccagttcacttctggatgtcccacttggtaaaagaaagtacatttttcattgcatagtagcagcatccacagcagcagaagtagcagtagaaatagcagtagcagtgatagtagcagtggaagtggtagtagtagcagcagcagcagctgggataataggaatagtaacaatggcatcaggagcattagctaacattttattaactgttactatgtggcaggcactgttctaacctctttacacgtttccattcatttaattttcataacgctctttgtaacacgggtaattcccatcttagggaatactgtctatgagaatattattcatcaaaaatgagcaaagggacaaagggagaatagatatgcagtgctcaaagtttagagatgctgtgtagtcatttgaagagagctgaacaggacttcttccagcctaaaagacaacagaaatcctcaggtgactaggcacctgctgccatagatagcttctgatgttggagagaacacagagaaagctctacagtcctctgtgtttaggatcccataacctagaaaagaagtataacctaaaattaaggaggagaatatttttattctaaagatgaaaagtataagaaatgatttaatcacatataaaaaatttatgttgtaaacaggagcaaaggcgaaaaaaatctcatactgataagggcatttttatgaactgaaacaggttgctgaaggaggaaatagaatcttttcccctagaggcatttaatgtcaggactaatagcatcaggataaaatgctataagtaaaaccctgagaaagaagggataaacctctagagtcattttcaggtctatggttttataaagtaattcttaaatgtttaatatattagaatgggaggaatagatctatgtgtccaaataattaggacattggtttccttcaggattctgtcttaataaccttgaagactgtggtgaaacaaagaacatcaaggtcaaaaagaattagaaacaaatgtgctttattctcattgtgaactgatatgatagataatacttgagctatataattataattaatttgaaatgcagtacttgaaatttaagcagatgtattcctctcactgtaacactgttagaggtaaaataaaggagaataattttatactcaaatctagtaaaattagcgatccatatggacttcattttatgcaaattattaatcttgtatttgcacttttgcgtttgggaagtagaagaattgtaattcagaatcggaatgttgaaagtgtcatattgtttcttttacacgtgagatgatttacagttttaagtgttatgctcttcagaagaaaaacaacttacattgagccccagaagtcaacatgaggagaaagcaaatgacgttttgtttaacttaagaaaaagttttcctagccacctaattttggaaaatacttggaatatgtgtgaataaaaatacaaaatacataatgttcatccaaagggcttaacattttatattagatacaaaataagaactgatgggtgtgttaataggaatattaaatagaatttctctcaaggaaagattttaaaggaaatgatcataaacattgtgccgataaatcactcatcatataataaacaaaacatgattaaatatttatctaaatttaacagttttagatgcttaagttttgcttgggttctattaatttgtgcatgtagttaagaaatatatcttgccattcargtagacccagttctaaacaaaagttctaccaccaactagcatagtgacacgtgaccttgtacaggttagtaacatctctaagttctccatttcttcgactgyaaaatgtgaataatgatattatttatctcagtgcccttgtgaggattaaattaattagtgaattaagtgcttcatacagtgactgatgtttgataggtgtcagtggagataacattttgtaattattatatatgatttaaaatgcatgtgataacaccatatagtttaggttatatgtgtatatttgtacagtatttcttctgatgttaaatttctgtatacaktttcttgtaaataagaatagaaaatagtgtctccatcttctctctacacatttgcacatctttccaatcttacagacctgggtgattgtgctgtaggctagaatatgcgcagactctagtcaaacatacttgatatctacttcctcctctggtgcatagtagatggatgtgggataagtcacctagcccatttctgaacttcagttgtaatctgtaaaatgagatcattgatagctaactaataggttgcttggaagtacagatgtaacaatgtcaagaatctccatagttgacatagaacagacttaatactgaataagtaaagtgtccacagctgctgttattgcaatgtgtgtttgtccattagaggcctccttttaattacactttctttcaattaaataatgcaaaataaggtaattagaaaatagtatgtttaatgtttttgactaaagttttgcactcactaaatggaagaataaataattagttaggcctaatatggtcatgtgccatgatgttatttatcaaacattatttagttccatttagcaaatttaatgcctactatatgcaaaacatcatgttcaatgctggcaaagggggatgatgaatgttaataaattagatatagttctgctacttagtgacttaaaatccagtgattgacagaaacacagaggttaatttacggttgtcagtaaaagtatatgaagaaatgcataaatggtcgagtgcagtggctcatacctgtattcccagcactttgggaggctgaggctggcggatatcctgagcccaggagtttgccaccagtctgggcaaaaccgatggaatgatgaaattccatcttacaaaaaaaaaaaaaaatgcagaaattagccaggtgtggtgctgcgcacctatggtcctaggaactcaggaggctgaggtgggaggattgtatgagcccggaagatggaggttcagtgagccaagatcatgccactgcacttcagcctgggtaacagagcaagaccctgcctcaaaaacaaacaaacaaaaataaagtactgtgagatagaataggaaactgtgagatagaataggaatacaggattgtctgaatggagtgaattggaacgcctccttatgcaagtgacctagaaaggaagaggaggctkctatgaagtttaaacgctctctagaaaacagcatgaacaaagaaagacttggatttgagaaagctcagagcatgttcagggtactgaaatgtagggtgctggtgtgcttatatgtatgtgcagttatgtttatttgtgaaaaatgagctaagggtcagaatatagggggacataaattttaaaagcataacttataattatattgaagaaggacttgaattctaggccaaggtgtgtgatcttattttgtatatattgggaatacatcaaaggcttttgaccaaggaaatgaaaaaacccaatttttatttgagaaagataaccctgatgccattgtttaagatatgtctgcagagagtgagtttaaagctgggagagcatttaggaagctaatgtgaagataaggggaaaaagcagatatcgtctgacctagagcctcagctgtgaaaatagagctgactcaagagatctatgtcagcctggatagtttggcctcctctgttaaacagtgtttcgaatgacttgtaagtctagcagcctgaacatgcagcgtagtcctttttagagcacatgttggaagagttgatagatgtccattttcccgtgcttatttactgaaagactccaggaaaggtacctcaatttgctttctctgtaaacagaattacttgctttcatccctttggtctcagagagttttaaggattaattagttgagacgaagtgcctcaaaaagaacaagtatggaacatatggttttcctgatacaaataaatcttatagatgcgtccatgctgtctttggaagcccagcaaataaaagacatgcaaaaattgtgtaaagtagaagataagctgagatcaacaaataataaatccccagcattagcttttgcataggaaataaacatttctgtccactgacaacagctttcttttaaaggaaaacaacctgatgataagccccaaggccacattaatatcagccaaagaaacatttattggttctcttctggaaaccataacaatgagcatgttgcatcaaattggtcacacataaattagtttttttgaatcgataaccttttatttattgctgttaaagtgatatatttttcctaaaatatttgttttctttctgtgccctctttcttttcaagttacctccacagatttatgtcaaaatattatgttcattatacttttgcyagtggcttgctttgatgcaaccataaatgaatatcattacactttacaaagataatttattttctaggctttgctgtcatgctatatgtagcttgtatagttaaaacatatagaaactaaaatattttggggcctaaagaaagtttattattttgtttttggcttttcaaattgacattctccattgtatctctataatttaaggcaaccaggtatgacatgcgcaatttatttgctaagacaaaccagatatgctggataaagctctttggggcagtcttgcaactctctccttgtccccaaattcagcccatttttattagcttctatctggctcctgattctttgctgcatctgtcattctcaacttgactttgttctttctcttaaggataaggataagtcttaaggataagactctccttatcactgtttacattgaaggatacttagtcattaggatgtctctgtaagactttatacccttaagggaagactttaatgtgcctgaagctgtgtttttccaaatgtaacatttaatatctccttaacactcttttaatacaccctatatagttggcattgctacattccagctatgtgatattggtcaatttactaaacttttcagttcttaatttttctacttataaaattgtgataataagaataattgcttcagagcattgttgtgagaaaattatatataaaatcacaccataaataatacatataatatacttagctcagtttatggatcacagtaatagttcagcaattgcatattattattattgataatagtaaccgttattatgcaattgctccgtattgctcctcatcctgtgttcccattcttgataaatgttaccaccattcgaccaatttttagaccaatgtcctgaattatcattgacacatcttcactcatcttatttctatgcattgccgtattcttaagttcaagccaccatcatttcttccttgaattactgataacttcttccttgaattactgataaatgttaataaattagatataattcattttcataattccttgaattactgcaatagctaactcatctccctacatttcccttgcatactgtgcaattcatactcataatagagctggagagaattttggaatatttaagtctgatcatgttacctcttrcttaaaatgtctcagtagcctctcataacttctaatatgaagtctaaaatccttgatatgagctataataaaagcccagcatgacatgtcctttgcctaattcccctgtgccattcatctcctctttatcacctttgtactcaagctttggcttttctgaactttccttattttcaaaaatgtcccccagccccacttccaccygagacattcacacacccmatttcctcttccaggaaggctcttatgtcgcctgggtaaacttactcttcaagtctagtgacttttttccagaagctttcctgatatctttccatttcaccccactgctgacttattaaaatttctagaattttatacttttacactacattctctgtgttgtattctcttattcagggtctgctatttaatttttaagttccttgaaaatagagacaatttcattgttttcatcagtttggtccaagtatatataacatagatgaaaaatagatattttgtattatatatattatataaataattgttgaatgagatgaataaactatagtgagaagatgctaggctttgttaaccattcaaacctaagctcaaatcccagcgcggccacttgctacctctggtactttgaacaaattctttagccttgtttctttgattttgttttgtttcagtcaggaaattgtaagataattatagtctcctcattattcttgtaagagtaaaataaggaaacatgggtaaagcacttaacatagaatatattttctataaattttacttcctcttttttttcatttataaagttgttcttccaragtagtagtattaacattgaatagtgtaaagcattcatgccattttattgtatcttctcttaggacatacagaagataatttggtccctcttgtcaatattcttggagtgattgatgacaaaccattttagtgtccctagaaatggaggacttactgcccctttttttcaaaaatgaatattctttttttttggctataatctgaggaggagatgcagtgatctaaaggtaaaagtatcagaaaaaagaattgtccttttgctgattgatttgagggatgtgattatgtagtacattgatgctgactcaycctgagtaaaaaattcgttacattctcatttcctcctactaatatatggctgtggtctttcttacaaaggcctttaaattcaccaagtataagctctaatgaaaatcttgtgtatttttaaaatgtctcttacttgatatgtaaaggaaaacagaacaaaggcattgaagaggtaactcttttggttttaggaatattaaaatgcaatcttcaccagctgtccatttttaaattagatttcagtttttcacrtggggtactgtgtgtgttggttagcattggagtaagaatttaaattcttaaaagctttgaagttaattctgtattaagaaacaactgagaggttgagtatggcactatttcttcctgaatctgagatcaagcagwtktgcctctttcaatcagtttttactaccatgagatttaaagcaaagaaaaaaaaaacagttaatgacagttcaaattcacttagtagagtaacgtgttctaaaatggaggattgtaatggttgaagaattgggttatgtttttctcttggtgtgtgtcattttgtattgttttgtcttgccactaagttaatttgatgcatttccctcagaaattggggtagtggggtgtttacatcagaagactatgaccaaagtaaaatgaggggtgaaatatgcttttaaaaatatagagcaaaagcagtgattgatactatagatcttcaattttatcttcaggttctagagttttccagatattcactgtagaaaaaaaaagacttctggtcacaaattctgttactttcacaccaaaccccaaaacatttcaccgaatttcttatcttcctactctttcatttctacyattttctttctttcttacaaataaaccttccttatcaaatcccattttctgtgctttatttgagcaattgatacatyctactttctttagatatcattttcctttgcctccagatacaactgcatctatggggtctctgatttttatagcttgttagaagaagatgctgtattatataggataaaaattattatataatacctatgtatacaaaataataaattcccccataatttaaaaataatgtagtattatagtttaaagtaggttctcttcatctacttcctgaaactctacagtgaggccaaaggaattgaatttaaagaataattctggaatgtctataagttaaatagacgacttgatttctgagtcacgttcagattgacgccacttcttttcattgctgcatttgagaaaatagtgtagaaacaggtacattctgactatataagacataactaataaaagtgaaaacaaagaacaaaagtcagggaaacactaatggttctagagcactaatgggaaaatgaggaagtacatcaagaaagggctaaactgcattcaccttgacagctggtagaggtgatacgccaaactgcattgcagagaacatagcaactgcacgatgtttcaacagtcattttgacagggaaagtccagggacaaagaaggaaaatgaatataaagagcaaaattttgttaagccttgaaacagaaaaatttcccatagggaattttttaaaaatatggcagactagaaagtattagttgtcccaaaggagtcttatttttccaattgaagtagctgctgcttatctgaaacttaacagtttgttgtggccaaaataagcaggtggttataagaaattaaatttccctggagaatgaataatagtgacatacaagtaattataatatcacatgattcacattctgaagaaggtcaaataataaacatataattcatttccatctgccaacatgartatttgttgagtgcctactgtgtgcctggcacagctagcttcacggttctatctggatatatagatggaagacgggtgagtcagagaaagagataaagactttttatatatacaagcacaaataaaaaaaccgttttggaatttttgcagaattgcaaatgttacttcatattttaaagtcaaaaaaatagcaaatataaaacacttaaaatttttttctaaaaggtagtatttcaattttaccatagagagatggttgccttatctaacatctcgaaaagagccaccctttgatgttcctcttcctctctctcttcctttctctctttatccctgtcttctacacctttattaaaaaaatggtcttctcagtatttttaatatagaattctgcaaatgaaataaagaacattacttatgtaggcactgaacacatttcaatgtttttctttttaaagaaaatgacaggttctgcacactggtatctactaaaaatgaacccaactttgcctctgagaatgttactgtgaagaaatgctgcatctaaacttcagccaaaatatgctaattagaaaatgaagctgaatgaattgctttgctagatgagattatttggaattatattactgaattttggaaattatgtgtcctatcaaagaataacttttgtcataatgtcttccttagctcacaggacatttattaatgccactcctggtccagtcagttcagccaccatttagagaaagtctaccatgttccaggcagctaccagcttctaaagatctagagacaaataagaaccaacttttctttgtttcacagagtagcacagatgacaggcatatttacacctaattataatgcacagagattgagggttataatggagatattgctatgggaacaaaaatgagtgaacaacatatcttggtggaggtgcagaaggtatatttactgaagagaggaaagtaaaaagagggagatttgtaatctctgaggaagagtattcaagggcttagacacagtttggttgtattttaagcaaggaaatcaatgatggattggtaaaaagttaactccggggcaactttttttaagcattggtaacctgtgagaaaatgatctatagtaaatatttctttttattcctcaggcagtacttaaagcactgtttttaggagttagatgttttccttatactacttttttaatagtagtaataaccctctcaggtaagagttgttaatttttttgtagagatgaacaaataggttcagagagaatgagcaagtggttccatttacacagttaataatcaccaccaattgtctgtctgattgaattaaatataagagggaaacatatagaaatgaggagataaattgcagccttgatagaaaaggagaattgtgtttgtgctatggttcttttgtggtccatagcaatttaattctttgtgatgaacgtaacactgataataccaaatttcaatgaccacatattcaattcataataaacatttattataaatgccaacaaaattggtaatttaaagaattctctatttttaaaaaaagaagacaaatagattacttttaattatatctagtcttttcctcagcctgttctattctgataaaggcttaagaaggaaatggttctgatagaaaagaactaccctgaaatgtggattaagacttgtcacccatagaaatcctaggttccacagctgtgaccaatccatggcattcaaagtggatctctcaagaagaagcactgtagttaagaaaatttctaaaagaattttgttcattcttgagtcaaaactttgatgagattaaaacattttgttccacttctggggtctcagtgttgaacaattttagcctctttaagatgaaaatacttttcttgaggtttttaattttttttttaacttcaatatcttttggggtacaagttttcttttttttacatgggtgagttacataggtgaattctgagattttagtgaaccagtcagccaagtagtgtttattgtacccaatatgtagttttttatcccacaacccactcccaattttcccacttggagtcttcagggtccattatatcactctgtatgcttttgcatactcacagcttagctcccacttataagtgagaacatacagtatttgagtttccattcctgagtgacttcatttagaataatggcctctggcttcttccaagttgctagtaaaaacatttttacgttgctttctgtgggtgagtaatattccatggtatatatataccacatttcctttatccattcatgggtcgataggcacttagggtggttccatatccttgtaattgtgaattgtgctgctataaacatacctgtgcacatgtctttttcatataatgactggataaaagtactttaaaacaactaatgattccaacattatttccagtggtactggtaatgcattcaggcagaaatttttttttactcctggatttttatctgaactaatgcactttttgtatgccaattgccaattaaagtttctgattttttgcattgcccctgagatattttatagccttgggcaaaaaagtgtactcttccagaccacaaagataaatggagaaaatagtgcctttccttaatttatggcgctgttgtaatcatttaatgtgtgcaacatgctaaatgttgtcattatggtacagtattggatttctttgttgtattacggagcagaacattcaataataataagatagaacagctttttctaacaacttgtgttcaagccactgataataatgaaattatgccagatgaacttattctccaacctcttcctgaagagtcagtgggatacaaaatgtttgagtgaggaaaagcattaatggacagaaggaaagtgtagtcattactctggggaatgacatagttgaacaactgaacatgcttttcagaaatgattacactcataactatcagttgtactagttcggccttgaaaatacagtagctatcccattttacaacataatgtatagttatgtcatataattttactggaatcttctaatgtaagttcccattgttagcagtgaaagaaacagctggtcacaagtacattgtttgaaagagcaagatgaaatagaaattttttataagagatgcattcctgtaatgtagatggtgaatcaaagtctttagagtaagagttttattgcaataatttattataaacattatattataatgtctttagttcactactataatatccttggttctttgagaaatcctctccctcccactattcaataaaaatatctgatgcactttttcagggcttatgaaaacaataaatattgtgacaaatgactgttatcatgtctatggcgtctcatttgagtacagattcttttggcgcagaacaaacagggccaatgacttaacattaggcttaatcagttatcctagaaatttaatattgaataattctttaactttgggtaatagttaatcatagctactaggcatttttttttaacatctgttctttcagggaaaaaaaaaaaaaagaaaacatcatataatcaggtcttcctgaaattctgttcaatgtgtttctgcctaattctcctccaggactctgtttgtttctttaatgaccaagatttcttttagatgagtattaaattctttgagtttgtaaygcaacacttgcaaatatttcgctagaaatttatacacacayatctgtcattttattctacaaattgatgttttctcattctataacataaggaactcagtatttaaagttcaaagcaatcaccactttaacaaactcttgagcttgtagttgaaagttcacacacattttacagaagagaaacacagctagagaaaagagcctaatcatatagtcagtaacttagattcatgatgactattctgtcttgaattaaataagctacccttatttgaatagtttgggggacatctaactagtatgtttttaatgtatattttcattaacatttcagattactcattcattcactaacatttttggtacatgtgccatgtacactattctagatatgtggggttttttagtggttaaaattgtcaggttagaagccagatattatttattaggaatttacttcagctctccattttgtaatttccttgtgtctgagaaattgtatctactttgtagggtttttgtgggtatcaaatacataaaaacatatgtaaagaataaaatgaagcctgagccatgttatggtatcaaatcctasatactattaattactgtattctcatttaatcctcacaataagcctgttgggtaattattattattctcattttgcaaggagccatgctatcctaaattatacgtctaagaaattccagaattcagatgaactcttagaatagtccgaatttcaaaatcatgttctttccattacattgatgacaggacatttcaggcaaaataaatattgtgagcataagcatattggtgttgaaatcagaatgtttcatggtggtctactgagaatttacccctcttgattttagagttgtgggtaggtaatgttgaatagttggatggccagtttaaagacaatctgaaaagacaggcattataataggaatttgctgaggttgacatttgaagacattgattatatttaggtatgtcttaagatggcaggaaaagataaatctgtttggaaggggacaagattagcaagacaagtgaggatgattttgtaggaatctaggtgtgaggtcacacagccagactaaaatggtgtcggttaataaaaccatgtccagaaaaccatagatatttataagaaacaaatgataygttgatagactataataggtgaataaggggaaagagtaccttactttctgacttgagagattggcctccttcacctagtaaataaatcaaaatggaatacatgctatgtgtctgcccttgtgtttagcaccatgcagtaagtggtagaactagaacttgaactctggggtgttttgcatgaaggtccttactctcaatttcactatactgcctccaacctatgagtgccatttagctattttgattctcattctacagatgaggagaatagggctcaaagatgcctcaggttgtcttaacaacagagttatcagttgtaaaattcagaaccttcgaaatcttgttttgtacttcattattattgaattcttttatagttcttttagcataagtgtgagtctctatgaaaaattattttatttacttgaggttatgctgtgcctcatatgtttgatgacacattggttctatttgctctgtgtgtgcgcctgtgtgtatgttatatacctaggcttgagcagggcaggggaggcaaaatttcctcattgtccagagtggaacctctcagtctttcaaaggagactcctgcattgggcattggagatgtcttatgctttttgcctttgctacacacttctgatcccggagaaacgattttcattctccagcaatgatttaaaaaataatttatcacaaaaattaaatagattgcactgtaaaaatcatataattactcctgtaaaactacagatgaaagcatgcacagaaaattatagtggaaagtttttaattagcttctgattaactgtaagcttatgttttaaatgtaccatgcagaaccttataacaagtaggcataaattaaatagycactaatatgtatgtagcaaaaatattaatacggctgctactagggattttcactggcatatttttaatttttttttttttttactttaaagtggagtagattctgtagagttggggtatcaatcacatgatcattaaaagggcaaaatattttttcaaaacttgtgcaataatctttacctaactggctatgtggttggtgatttgttcctctcttaaagagcgaacaggcgctctttcaaatggagatgcttacatgatttcatgtatattcttagttttcatgggagacctatcccttcagtagaaggaaatgctagctttaggtcacagcaaaactaagctttatttttcccattttgtctagtctatgtttcacatgttaaagttgtgaattggacacttaatttgagtgagagtcagggtatttttcaaactatatttagtgactttaacttgctgagtgacctaggacaagtcatctaagctctctgggccttagtgttctaactggtaaaattagaaggttaaattaaatgatctttttacctagtgtcaaatcaaaagaatcacatttctatattaattgtatttttaaggttgttggtacctaggttcttttaataatatcttggaaataaaacattattatattctttaaaatgtacatataacaattgtacatatttatggtatgtaccatatttatggcaaaatgtgatgttttgataaatgtataaattttgtaatgatcaaatcagggtaattaacatagccatgactttaacatttatagtttctttatgatgagaatattaaaaaagtctcttctagctattttaaaatatggaatacattattgtattatatatcatagtagtcatcctgctgtgcaatagactaccagaccttatccctcctatcttactgtagatttgtactcgttgacaaatatctctacaagtgtttttcacaaagaagcccctcagtattctgacatgaggaaaagcaacgaacttgctttccatttatgcaaattagattgttaacttcctatgcaactaggaatacttaacagtacttaacaatatttatattgttcctttggacataagtatggctatgattgcccccacctcccaaaaaaacaacaaaaaggaatcataggaaacaatttttaaacttattttcaattttttttattattgattaaataaaagcacaacttaacaaaatataggcagtcttgtactttatatacaatgatccttctggggagacatggaaattcatctgtcttcctcaagccaagtgggactgttctgtcctargagaagggatttttaaggagtggggaaggaaggggaaaaaaaggaaatcttttccttattgtcaccactgcttacccttttcaaagaagtatcttcggttcttagaaatcccatgcccagggtgaaaatggagagaaagaaaacacaggaagaagagagtatatatagagagggaggccagggaactaggagaacagaatgagaggcaaggtaatctctctcacccttttaggaaaggactctcattgcctgtgctccttctttacctgacaagctgcagttgcccctacctctactgttgcttttgttcctctgtaataaagaggtagagaagaagggaagaagaacagctgaaaagcagagaaaggaaagaagagttggcagtgaaaggcaaactcatagattgccttaaaacttccatggctgccacttctggccccctgtccccactgcttcatcaccatgggctgaagctagcatttaaagggggaggaaaagagagaggaatctgaagacaggaagctctagtctctttcagtatccactgtgttcttcatctacccaccccctcccctcatctgacaccttgcctaggacaagggctcttaacccctgagcttccaatagtccctaaataagctgtacaatgttttttactctgtgaaattgtaggtagagtttgggtgtctttggggcggggagggttcatagagtttctccgatttttagatacacccagcataacctaactcacctgtgctttttaatattcttctttggcttccataggctcttctgaaaacctaaccactatatgcacaaagttcttaccattggaaaacacctttaaatgatacacagagaaagtttccagaaaaatcatttcaaggttggagaaaacctattatacttttttaaataaaataggaaataataagctggattgaggtaatatatatttggctcctactcacacaaaaattttgaaaaagaaaaaaaatgtttaatttattttttaattcttcatttgtaatcacgaaatatctgaactaaatatttgaatctctgcaaaggctgggagttgctatgtgttgttgggaccacactactctcatatcctgtgtaaataccccatgactgagtaaatattatcatgcaattttagaattagaagtttagatgttttgacctaaatgttttccaggkttaaaatatccttcttacagaacagtgatcctcataagtttaaacagactggaaacaataaagcctaaaaagaaaatcatgcacatcaacaattttctttctatctttcaactttaattttcacccttayagccctaaaccactaatttgaaaagatttttctaaaagttcatctttctaatatatcataatatttctttttttctggccctggaagagattgagtactccgtattttttaaatatataatggatatattataaatactagaaatgagtacaatactattatttaattttgtgccaatttcatgaatgaggaaactagatattgagcaaagtgcaaagatagacattacagtcctgacctctggtaagtatttcagaattgtcactttcaaaaggtaattcaagaacactgtatttatgtatctctcaataagttcactatttgcctctcctatagaaacatggtagttgttgtgtgaaccattatccaaagcaaagttagatcaatactactgaagtaaataaattgaaaactatattaaaactgaaaaatgtggttgtgaggacatgcaagaaaaacaatgtggtgctactagcctggaattggtatgaataagccctttaaaaaagaaaaaatgaatccttaatctttatgccttagtatcttacaattctccattaacctttgataaaaccatcatattgggcacaaaagaaacacagtcaatgaatttttcttgatattcttttttacaggaaaaaaatcaaacaatgtgattcattataaaacctatggtcagaatcaataatctatgccttcatatcatgcctgtttagataataattattaagccaccatttaaaattttttaaactcaaattccatctgcaaaaaatctattttgcttttaaaacttaatattaggtttcaactttactttctgtcatccttcttttggttgccacatcagtagactcagaataaaagcatctgcccaaagcaaatacactggagttcactgtcaaacagagattcccaagaaaccaaacagaaaaggaataaaaatgagaagcatgttttattaaatgtcttctacacctgcttcctttatcttttagacctgcttaccaaagcccattggatattttgattttttaagtcacaggcatatgaactagcttgaacatttatagtatcaaattattaaaggtaatgacctggtatttaaaaaatgatgttccacatctaggggatctccatgaaagcttttcagctgaataaaggttataattgttaaacaaattggttatttattaagctagcactataaacaaaaagagtatttaaacagctggtatccctgtgaccctacctttaatcttctccagagaaaatgtgacaagaagtgatatttaacaataattttagaaaatgtaatgaacaccaattgattatgtaacttgcattttattttcaaaattacattaaaatagtatgcaactattcatttaaatgcattttagaattaaaatgaattattttcacctacaaaacttatgtttaaaaatgagatagtactgttttattattgatctacattaaattagcaatatgttaaaattcatttctatattgtaatgcttggaaaattataaatttttgaactttttaaagctatgcttgaaagttcaagagagccttactcagtaatgaaagttaaacaaacaaattaataatacataaacaaaaaggttgtttataaccagtcctgcacaattttaaatctatgcagtagagcaatgtatgataattttaataaacacacaatatatcaacacattttcatggacactatatttttaaatagaaatttaattttggaatatttttaaatgtatagaaaagttgtaaaactagtacagagtttccttatactttatacccactttcttctatattaatatcatatttatagtacatttatcacaattgagataatattgatatattattatcaactaaaattcatactttattcagttttcttttttagtttttacctaatgtcctttttctgtgacatttacataccactttatgtttagtcatcgtgtctctaagttcttggctgtcacagttgttgaaactttacatttttaaaaataattttgacagttttgaggggtattggtcaggtatttactagaatgtctttttatttgaaattgtctgacatttttcttatgataatattgggataacagtcattgggttttgggaggaaaacaacagaggcaaaatggcattctcatcacattaaatcaagggtacttactgttaacatgatttactactgtccttgatcccctggctaagttggtgttgccgtatttctccactatgaagttacgcttcttcccttttttcattttgtggtctttagaaggaagtcactatgcaaagctcacacctcatgttccagaagctgcttttccaaggagtgaatatttatcctccacccttttgagtgtggagcatttacttaaattgtttggatttatgctctgcatgagagacttatctattatcttccattttaaaatgtatttaatcatcctatcagtatggactcatgaatatggatattattttatactatgaattatagtccattactactctattttgttgctcaaatagtttcagacattatcttttgaactacttatggttggaagttcctagcacaatgccagaaacatagtagacgttaatggtaatttagtgtgaacctaaacttaaaaatatgctcatgggccattttttaatttaaaaatagaaagtatattctattaagaggtactcgatccctaattgcaaatccccacttatatccttcgaaacaaaaaaaaaaaaaagaggagacatggtatataatttagatattgccacagtaatgtggcattgtatacaaccatgaaactcagcagcagacaacaatgaaaatgtatttagctcatgaatctatcagggtaagctgatctgggttaagtttggctgacttgggcagggctcactcatatgtgtatatggcagaggtggagtggtcacagggggagtcatctggagctagtaatgcctcagatgacataagtggagcaactcagctctggtccatggttgcctctcatcatgaagcaggacagcctgagcttgttstcatagcgatgagcaaaggcaagtaagcaaaatgtgtaagtgctttctgcttgtatcccatttgctatccttacagtggccaaaggacagcataaggtgagcccaagttcaagaagtggggaaatagactgtaactccgtggtgccagaaactgcaaagtcacatggcaaatatagtgtctacaggaaagggtaaagaatagagaccattaaaccaatcaatctaccatgcattaactatacaaaggaacgagtctaagctctcatgggtgtgtgtttattatttttgaaatcagttttcaccctgtttttgttatgaattatgacagtgagtggaagtgcagcattatcattaactatgtcatatttcagaagccgttcttcccaaactgaggaccaaatcatttaaaagtatgatagtaatttacttttcaattctgcactcattttagattataatgaaatcttactgaacaaatgctttttaacagagtatgtttccaatatgaatgaagatttcatgcagcaaaacttgagctgtaataatgaacaggtctgaaaaaacgaaagaataagctaagcctataaatctcttccatatacatttatgacagaattagacatatgaatactctattcttagagaatattcagtaaagcataaactcttacttataatgaggtctccatggaaatgctctttcaaatagagttattgacaattgcaaaatatacaacttgcaaatttttcgttttagggtttgtttaaattaagctttaagaattcatgcatatcaaatcctatttttttctgtagaaaaattcaaataaaatcatctgaaataagtcccctttttcttaaaacatttgaaaataatgtatgaaatgtaattaaacataaacttsaatgttcatatctcaagttctaaatacaatcctggaagaagcagtttctattacacttcccatagaaaactgcttatgtttgaggtagcattttgttttgaaaaagatgtgagcttcagatcctccaggaagctctaggtagatattccgattttctcttttgtaaaattggtttaaaaggtttttgtttttttaatctctctgatcctcggtttcctcatctgtaaaaaggaagtaatctgcctgcctcatatgggttttaatgagaattaagtgttacataaaatgtcaaacttagcacagcgcttcacacataacaaactccttactaactccttactcctgccttccaagatgtacacttttacatttacttacttagtactccactccaatagttttcttttgcataatagaatgcaaaatgcatactagaaaggaaattgtcctgcagagtttcagcaaaacaaatgactggcacaaaccagtatgttattacaaggatttatatacactcttgttctaatcatattctgtgaaacgtaacaggagcatgtattaaccagcttcatataaccaattttccaaactaatatcaacactaaaaagattttcaggtatattaagctggagaactttgttcagaagactttaagaagtggccatataggaaagcaatcaggattgcaaacattaaactttagcataaataccacttgttcctcctttcagagacaatgaaaactcttgcttatggctataataatcaggctacaaggatttctaagaactgttcttagtttaatttttctgctattgccagatgcttttcaccattytaggtgcccaaatcctgaagccaaatttaataaaggagaaacaggcctaattgataaatggatgttcagtatgcgttttccagtcagaacttgccttggcttagtggaacattctggtagttcaggcaaaaagtgtttcactacaagatcctgaacactatattgcatagaatatttgaaaaccagtgatgtccaagtcactaaattcttcctttacttctttcggatgggactaaagagaaggagtagcttgaccttgcttctatcaccttaagaaatatatgcacactctcaaacaagctgatacactgaacactggattatagacagtgcatttaaattttgtaatggatatctgatgaactagtcagagggattgaatctaccaattaaagtctgtcccactgcaaaaatagtcctcctgggtctgttgccaggaagaagactgagtaattaagatcaatgcagtttttttttgtattctgatgtccatcccccaaaacatcacttatttcattgtcccaccaagggggatataggaaagggctttctatcaccttaagaaatatatgcacactctcagacaagctgatatactgaacactggattatagacagtgcatttaaattttgtaatggatatctgatgaactagtcagagggattgaatctaccaattaaagtctatcccactgcaaaaacagtcctcctgggtctgttgccaggaagaaaactgagtaattaagatcaatgcagttgtttttttgtattctgatgtccatcccccaaaacatcacttatttcattgtcccactaagggggatataggaaagggcttaattataagactggtcagaaaatataagacaaaggtatccttgacattaagaatttcatgattcataacaactttaaaatattgtctattctccatatgaagtgactttcccttttaaattatttggtatttatggaactaataatgtgttgtgctaacacagagcttttcatccaagaacttcaaagcactctttatttgtcacattctgtgatcatttagtttgactataaaatattttatgattaatattggagcgagaaaacatgcaggaaaacaaagtataatattgggggaaatttcaaatacataagatttcatcctgactaattatctcagttttctgtagcccatggtaaattaggatgaaatatgcttgcacttaaaacttagctttgctaacatctgtttcttttaaattagattttaatttaaaatggcttgtccttacttcaaaaatatgagattatttttcctccgattttgagtttttcactaaaaatcttatatattaatatacataaatgtattctacattggcctttttatcctcttgggcaattactaaagtaattcatagacctgttcttactggtaagtagggataaattaaattgtcaggacactaaagtaacattagataaattatgtttcactgacttaaagacagttaattctctagaaatgaagcagtttatttcttaactcatgggtaagtttatattggaattttgaaggtgctcgtgaaatcattgtttaaatgaggtcttatttagttgagcacctaatgaaatttcttgccatttctcccagtgattatacatgtatatgtaaactgtcaaccagtttcttcatgtgaaacgcatcctaaacttaatattttaaaatccttatatatgtgatttaagagcaagcctctggagagaaactgttgtatgaaaataagtaaaatcattgtttggcttgctatattatagtctttgcctatgctactaatcaatgatatggcatcaggcaattccttaactttcttcaactgtaaaacaagggcatacaggttaatgactcctcaggtcattttaggcttctatatgatttaatacatgatcactttctaaaatatgtatttttttatctgtttctaaaccatgcttatggttgtttactactgacaaaaatataagattaattataactgatgtcatacctatagtcagcagtgctgaagcaaccagtgacaagtcatacaacaaaaaacgtgtctcctagagctgttaacagtaaaataaaatccactcttactgcttctgaatttaaatccgagtactttcctgagtaaataaaaggaggacacaaaccctgctggacgtttctgagagcacattatgactgtcactattttctttccattgctatcatatgactcaatgtcagcacagtgctattcatttttactctttatagggccataagtaattgataaaatggtattggaagattcatttgttataattcttttagtagcaagtaataagatgctatctcaaactagattacataaaaatgaaatttattgggtcacataaaacttagaaataatggggtaggactggctgcaggcctagaatccagagcctatatgatgccaaaatgcacatcttaccattgcttcacttgtgtattagtccatttttatgctgttgataaagacatacccaaacctgggaagaaaaagaggtttttttttgtttgtttgtttgtttttttttgagacggagtctcgctctgtcgcccaggctggagtgcagtggcgcgatctcggctcactgcaagctccgcctcccgggttcacgccattctcctgcctcagcctcccgaaaaagaggtttaatggacttaacagttctacatagctgggcaagtctcacaatcatggtggaaggcaagaaggagcaagtcacatcttacatggatggcggcaggcaaagagagagcttgtgctgagaaactcccgtttttaaaaccatcagatctcatgagacccattcactgtcacaagaaccagcacaggaaagacctgcccccatgattcaatcatctcccaccaggtccttcccacaacacatgggaattatggaagctacaagatgagatttggatggggacacagagccaaaccatattagtttggttttcccttgtcttgacttcatttggacaacttgttgccagtgtattttaggatggcagggattaaaatccatccattcaacaacttcagtgtaaacagtttattttattttatttatttatttatttttgagacggagtctcactgtgtcgcccaggctggagtgcagtggtgcgatcttggctcaccacaagctctgccattctcctgcctcagcctcccgagtagctgggactataggtgcctgccaccacacccggctaattttttgtatttttagtagagatggggtttcaccrtattagccaggatggtcttgatctcctgacctcgtgatctacccgcctcagcctcccaaagtgctgggattacaggcatgagcctgtatttaatttttttaaattaatagttctagcaaaagttcttcaactgagtcttcttagtttagtgtagctcacatgtccatctaaatcaatcttatgattcaataagatggactctttcttctggccaaattaagcatgtgcacatctcttgagctggtcagggttggagtggggaatgaagtcaactttcctgaactgcataaactgagtactggggaggagtgatgatgcaatgacagtcagggtgctattcccagaagggtgaatgactgctaggttatcacaagcaatagatatccactacaaacaaaagtcaaagaggaagaaaaagagagtcagaaagggaaggaccattctttcaacaactgtatttgaagtgttaccatgtgtcctgtacactgagaatacagatgtgaacaaaacagacaaaaaattcttgtgtccttatgtaactcttaatctggtgggagagacagtgtatatgttgacctctggcaaaaatattggtgtaaaacacttcatcatgtgggaattatttggattcaaatattaggtctaagactggatttgcttggttaatttctcactttcatcctctgtaattttgaggagctcaaagttgctaaagtttttttattttacttacaactgattgttgcctataacagaaatatctaaaaatgtaattatatatttttaaaccgatatcatctattataagtaattatttgctttgattatttttcctataccttttggagaaatctttagctgtttttttataagcctttcccaatttctgaaatactatatgtttctatgacaataataggacttcatggcaaaaatgagactaaaacattaggacatttcatccacaataattaataaggaagacaagctgaatgcataaagatattctgattaattcaactatattacatgaaccctttggtacatagatggtagggaaatccaattagctataatatttaagagactgctgtcctaatacatatatcatctttctaggataatagcttcttcctctgattgtacattttttttcctccaaaggaagaaaaagaaaataatctaacgtggaaaatttttcttttgaaatctaccccaaaatttattacaatagtgtaaaactccttttaaaattttaaatgtattcaaaataccatacttaaactattctatacaaattagaagcaatttattttatagctataaataagaagagattcctaaactctcatattttatagtaggaaaatgtatatttttatcaatcttaaatttaggccacatttatattttaaaggaaatggtgtagcctaaactcaaagtttatttgtaaataaataagtctctaaacaatcactcctatgatgtaaaataaacttgaaagcaagaattttccctctgctgcccactaatagcctttgctttctaaacctttagtcatatctgtcatgtcctttaaaaagaatgtgatcttccttaaagtatgagcttgatagtccaattattgatcttctgctactgggtatgatggagaatccttaatttttcacagactatatactgatctagtatatagtctacactatatgtttgtactatattatacaactttatactatacttaacatgtttgctttttacataattcccccatattgctgacataatctattattcataattcggactccttggcattttacttacttatctttatacataagggacacacataattttatttttaaaatgttagttaagcttttaaaaagtctcagaaaaacatgaaaaatctctataattcaataatgtatttattcagtatctactagggaggatttaatcgataaatgttaaaagaaaatgtttcaccatagaatagataccaaaattatatgataatgaattatctaattattatgcaaacattttattaggtatataggttttattattttcttgtaattctcaatacttgaattttacaagtgtcactggcaaatgttgactaatgacaaaaatgtcaaatacttgtctctgtgatgaagcaatcatgttgctacagatattgtatagagacacagcccagatgtggtggctcacacctgtaatccctgcactttgggaagctgaggatctcttgagcccaggagtttgagactgcagtgagttaggattgtgcactgcactctaccctgggccacagagtgagatcttgtttaaaataaataaatgaaggaaggaaggaaggaggaagcaaggagggagagagggaaggaagaaagaagggaggaaggaagaagcagaaataatgttataatactacagacgaaggtatatgaaatcaggatggtaatgacagttgcaaaataggtgaaagcatttgctcttcctgccagagcaagatggctggggggccttagacagtgagtaatcaaaattggaagcagaaactatggcttcctagttgctagtagctagggtaatgagttagagagttaggattaatgatacaggatttgtatttctcactagtcaggatccaaagaactttagaatcattaattgagagtgggaagtgtaaccaggtctcagaagaaattctatttaattgtttaagttatagacctatactgagtgcaaagttccatagtagtgatgacacagagtggactagaatcccagagcagtcattatttgaatggtttgtgcaattgacatatgcctcagtttttgtttttgttttttaaccaataagcatggaaaaaaaaaacctcctatgttrgtttcttatttttcatatatagaaagtcatatggaatactcctgctatatggtaagtactccacaaattacagttactaggctacagataaagaaatggtctaattttgaaataagcttatgatcttttggaaagtaagtaccttatattatgggaattgggtatgtgaataatcggggctcaatatgaaattttgaagttctaccattctgaattggaaaattgaagcaagtgttgatctgaaatctaaaatgtcatgtgcactgagatcaggatacacgtattcagagagcagaatgaattcaatctcaaggcagagggagttaacttctgtggcctatttatatttctgaaggagtcttccaggctgaaggtcagggcaaaaagtatagtcatttcttggagtgcaaaatccctgtgatgcagacactgttctatttgttgttgtcattgttgttactgttgttgatatttggctataacataagaggaaaagtgtgcttatagagatattttcttttctattctgtgaatatcataaaaagtaaggttagtaaatgttataaatgaattctgtcagaaaacactttataaaaggaaaaatctcacacgccatccattcaacaatatttaaagcccacttagtatttacaaggaactctactaatcaatgaaaattaacgtgatcaggctaaagcttttgaggggaccaggaaaaaaccaagtcataactagagaaagcaccttggggaagtttggctatagaaatacaaaggcatagcatctaagtcaaatgaggcgaaaggaagtcaagagaacatgaaccaggaagggaactctcctcctaggaggtggcacttgagaagagataacaaagaaagcattggttgcacaattctaatgtcaataagcaaaatattcattgattatctactgcccgtcttagaatagcacaaagggccttttcaggcttgtcttattttgcttaaattttgaggttgtgatgaagttgaagaagggaggatggacttggagaaaaacctccaagttataacttctcaaaggcagtaattagagagtatctcctctttgtctctgattcaggactcagctaaggcccagcaaatgggaaacttcctttttaaaaaaagccagtgtagtgctggcagtcattaaagatttgctgaattactgacctcttatcgcccacatgccctggggaatctgttagcagtccaccacctcttgtcactaatcaagatgcctttatgttaacacctcccttttaaaagcaagtcagtcaggaaacttaagtagattaacacttaatcattaattacctcatgggataaccaaacaaatttcttttctgtttaggctatctctgatcttctgccccaggatatatttttcaggcattgaaggactgatgtgagttactctggtagtcctggcacttagggtcttggtgaatctgcttggggaaaggaatgaaggcatggaaacaggacagaaaggtgaagctagagcagagaaaaagcactgaaaagaaacttcaactgatttttagtttcacctagggtatttctaggagttagaacctccatccaagaatgcctgagctaatgtaaattaagatctgactttatgtcttggttctacccatcaatcataatcactcggttattaacagagtatttgccaaaggccaatggcacttcgtgaccaaacaagaagaaaaggaaatatgaaagttcttaatatataacttttcttgtgggtttacattttctttttttttttagttctgaatcaggtaattgattcagtttttcatgtttgcacagtttatttaactatgttaactaaatggtctgaacagaatagttgctaccatggcttaagttactggttcagtgtctatggcaatgcattaaatcaagtttctgctcccagttttataaaaaggaaaattgactagatgagaacattgccaccttattcattatgtatagctcattagttcccttgtcaactttcctttgcttttaatcaattgaaagaaaaagtcttcatggatttttagtaggaaacatatggagctgtaaatcatcagtaatgtrtgaacttatatttacaggtgcaactgaccttgactgtgcatccttcccaacttacttcttataaatcctgtaatcaataagtgaaatagtattccatacccttcataattcaccttccaatgtctgtttttccacacatcatctaagcttctataaaacattcttttcctctgtaatggactccaatcctgtttataagttttataaataagagcttaacatttcttctcaatacttagaaatgacgataaaagaattagttgacaagattggtatcttaagaatttcaactccacttaaatatctaagtggatgctgcattttttcaaagagttaccctgagtggcaatatattcattccaagagtgttgcctttgcacatagatcattgcagctatccctttcaaatagcatttagaatctattttcagatttaaaaaatagtctaacattagttttaaaaaataaccaaaggtatttaatgcacaccactacatattatttctttctatatacatttgtgaatttattgggaagagtaaacagttggagatgtgtcaatgctgggtttgaggttggatgagattttatattattaagtggagattattacattagaatgagactagaaccaatctatcttgggcctttatacttcttttttctccctcaggtttgaggtatcaggacacatttagggccctgttaccttttaaacataatatgggctcaagtaaaatgaactattattttcaaaatatattaacgcattacaggatgttagccaagtaaatttttatacatatttattttactttaagtgaatatttaaaatacattttcagtttgtttcttaggataagtgagaaaaatatcaaatatttgagagaaaaaaagatttttaaaaagagcgagagttactcataaaaaatgagtaaattcggccaggcgcggtggctcacgcctgtaatcccagcactgtgggaggctgaggcgggtggatcacgaggtcaggagatcgataccatcctggctaacatggtgaaaccccatctctactaaaaacacaaaaaattagscgggcgtggtggcgggcacctgtagtcccagctactcgggaggctgaggcaggagaatgatgtgaacccgggaggcggagcttgcagtgagccgagatcgcaccactgcactccagtttgggtgacagagcgagattccgtctcaaaaaaaaaaagaaagaaagaaattacatttaataaaactgattccttcaactttaaatacatatactttttaagataaggtctccttctgttgcgcatggtgaagtatagtgagtatagctcactgcagccttgaactcctgggctaaagggatcctcccacttgagccccctgagtagcttggactacaggtcaccatgcctggctaatttaattttttgtgtatagagatggggatcttgctatattgtccaggctagtctcaaactgctaccctcaaatgatccacctatcttggcctcccaaagcctggggattacagccatragctacctcgcccagccaagattttgtttctattttgggtgcaccctttataagagatcaagtacaccattaacatgttatgtgtattacttggaaaatgaaatggaaacattatccattcaatcactaattctctcaagaagacatgcctatattcccaggggctaaattatatattttttctaactgcattcctaactccccagctttctccagatcctgatatgtctcctccctgttctattcatttccattgtgttgaaaaccatactctgcaaggcgcagtgtgtctgactgaagtatattatgcacgcgagctttccaaaagctgaaaaaaatattgagaaccaatgaataaaaccataggtatctaaaagacattgaataataataagagatatacaatagaatttaagaattcattaataaaaagtataactggagtttttctaaaataatggactcttaaaccagtaaaatatatatctaatttaaaatggtttcttttaaattataataaaacatatacatgtaggcacatcttattaaacaatggacaaatgtagaastaaatttcatttccacttaaaaaggcacaggcaggtttcaaatggttctgcatataaacttgctgacatgaataattttaaatcaggccagttatagctttcattctttgaactgaattcaaaactctcttacttttacattattagagagatgaatcaaatgtttctataatgcctactttcattcaatccacacccaattttagaggactgctgtcacaatgccaaaaaaacatagactgaagttttaataatgtttcttatatgataaagaaattctagggtaattttatagcacagtataagtgctgaacttgtgttatacctttcaaataacagtaaccacctctaatttcttaaagggctctttaaaaaaatgcatggtatgtccatcatagagcaagaaatgcctctttttataatatattcaaaatggaggtggttatgtttccttttacactggtattgcaattcattttctgttagtaagcaagaatattgaccaactgtattacactctgttctcacactgctataaagaaatacccaagactgggtaatttatcaagggaagagatttaatggactcacagttccacatggctggggaggcctcaggaaacttacaaccatggtggaaagggaagacgcacatcttacatggtggcaggagagagataacaagcaagagcaaggaaaactgccttataaaaccaccagatgtcatgacaactctctcattatcacaagaacagcatgggagaaaccacccccatgatacaatcacygcccacttggtccctccctctacacatggggattatggggattacaatttgcartgagatttggttggggacacagagccaaaccatatcaccaacataatataaaatcactttgaaaggacctcaaaatacatcctaaaatttgtttcaaagatgaaaaatataacttaaaataccatgacttctgaatcagggtagtttgcaaggtgattatcttcacaattagaaccaaaatgcttaataatactattttagtttgtgtaaaactttaaagagtattcatgctcttcatctccctatttctatcttttttaaagaaaagcagtcaattagttaaataatcactaatgcagttttatatgataataaataatgacaccaacttggattgtcttaacaaatctgaacagtgacttttcttttgagaattgaaagcatccctagaaacaaatttgcctgtatgtttaatgactcatacattccaaatacatccaggagacaatcaacagtttatctgacgtatgatatataaaacaaattatttaagtgaacttcatttatcttagtctatacgatataatcataatgctatttataatgagctcaaatagcaacaagaaaatattggagaagttaatattgaagaaataaaattaatcaagctgtcctactattcaatttctgaatattcagatacagtaaatgttagttaatacatgaacaagtaattatcaagaaaataatccgatttacaataactaacaaaaaaatcttatggatgagtttaaccaaggaggtgaaagattactacactgagagatcaatacactaaaacactgaaaaacattgataaaaaaactgaagaagacacaaataaatggaaagatattttgtgctcatgaattagaacccttaatattgttaaaatgtccatactattcaaaacaatctacagattccattcaatccctatcaaaatatcaatgaaattcttcacagaaatagaaaaaaatactctaaaattcatatggaaccacaaaacaccccaaatagcaaagcaatcttgagcaaaaagaacagatctggaggcatcacaccacctgatttcaaaatacactacaaagctaatagtaactaaaacagcatggtactggcattaaaacagacacacaggccaacagaacagaatagagaagatataaataaattcatgcacttatagccaacttattttcaacaaaggtgccaagtatacacgtgaagaaaggacagtctttcaataattggtgctgggaaaactagatagtcacctgcagaagaatgaagctagacctctatctctcaccatgtacaaaatcaattcaaaattgattaaaggctgaaatgtaagatctgaaatgataaaactactggaaggaaacctaggagaaatgcttcatgacattggtctgggcaaggatttttttggataagaccacaaaagcacaagcaagaagagcaaaaatagcaaaatggaattacatctaatgtaaatgctcctgtacaccaaaggaaacactctaaagagtgaaaatagaacttacagaatgggagaaaatatttgaaaactatgcatctgacaagaggtaatatacagaatatatcaggaactcaactcaatagcaaaaacccaattaatccaatttaaaaatatgcaaaacacctgagtagatatttctcaaaagaagataaacaaatggcaatgggtatatgaaaaaatgctcattatcactaataatcagggaaaagcaaatcaaaaccacaatgagatatcacctcactctgattagaatgactgttatcacaaagacaaaaaataacaaatgctggcagatgtggggaaagggaattcttatacactggtggaaatgtaattagtattagctattatggaaaacagtatgtaggttcctcaaaaaattaaaaatggaacaaccataaaatccagcagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtacacacacacacacacacacacacacacacacacmtaatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatctcatagaactaaagagcagaatagtggctcccagatctggaacgtgtacaagaggaaggatggggagaaactgagtcagcaggtacaaagtcacagttagataggaagaataggttctggtgttctattgcacagtagaatgacaatggttaacagtattgtatattttaaatagctggaaaagaggattttgaatgttctcgccacaaaaaaaaatgataaatgtgcgaagttatggatatgctaaatgccctgatctgattttcgcacaatgtatacatgtatcacaacatcacactatataccccataaatatatttattattatgtgtctcttaaaaacaaaatttcaaaaatggtaatcttgttatactaaggtttctgaaaatgcaaagagaaatgtgatatatatatgttactcctttaaacttaaagagtaaaaaattaaaatcaatgtatcctaaatactaaaaaaaaattagaatgttgagctaagacgacaagatgaaaaagagtagtacttttagtgcaggagtaaatttcagaattttagagattgtatttttaaaggtaaatcactacctgtcctgttaagaggaagctaagacagatactgtggttctcacctgtaatctcagcactttgagaggccaaggcaagtggatggcttgagcccaggagcttgagaccagcctaggcaacatagggacatgccatctctaccaagaaatacaaattaaaaatttagccaggcctggtggcatgcatctggggtgctaccacccagctactccggagactgaggcaggaggattgcttaagccagggagatcgagctgcagtgagccataatcatgccactgcgctccagcctgggtgacagagcaagaaactgtctcaaattaaaaaggtgcgggaagataagtttgtgtttatacctttgtaaatataattctgaaactgtagcgtatttttgacaagtgctttgcttttgttatcaaataatgctggcagtggaatgaggctcaygacattattatcaataaacacataaagaaaataaaaggctatacctatttttctttctaatgttctcaagagtaggccaaaaatataamaagcaagatactagaggtttagttaatctgattgtattgttttcatatagatctctagatttctgcaattggatgtgtttaacatgaaaccttgatatatgatttcactaccaacaacaacaaaaaatcagttgggattatgatttctaatggtgtggaaaccctgttttataaaaataagacacattagctacttaaagttcatctgaacctgaactgtaattatttcagagaagtcctgaaatcattttggtcctgatttagaggtcttctttgtcttttcaatttaaagcaattttcatgtatagatttttaccacatttccaccttttataaaaccctaaagaatatcagtcactaaacctactgtagtaactgatctgatattcatttaagctaaaactttaagctaaaagaaaataattaaatttgtttgacctaaaaagaatgtccttgcattttgtagtctccattaaaaaaaaaaaacactccagtaatctttcgaatcttttttcagccaacagctctgtaacatcttgcctctatacatgatactgcctttttagccaattccaacctagagcaatgagtaaccatggctccatccaattttccacatgacatctgtggcagtagaagtattaacaggacttctctcctggagagctttgccttaggaagagcttaaatttctgtaagaaagtcactgacacaggaattcagtcaggactctgcactaggactagaagctgccagggttcagatgctgacaaggcaatgtttcttatctctgagatttcgtgcccttcccccatgaagctatgctcctccagtctggcagggaactcgcctatggacaagagggtgacagacatcttttgatgatgagcatccacaggcacagggaacagaatcttgctattcattgagctgcacagctgtggcaactggattctgcccgggtgtcaacaatgggggcagggcttcagtttaggcaaaagggaaacagcttgagtataaatgaactgcttttaggctctttgaatttatcttccccagatgccctgagatttcagatccactctttattttactaaaacttcatagctgtgaagtgaccatcttctctgaaggctcacatggaaaaaaaacaaacatgtttctacatggtaaaaggcatgtttgcatatttacatatgaatatattgatggatccttggcattaatgattctacaactgtatgttcttattaaactctgggttcagcataaaatagtatcttactgatttatcttcagtgctattgtatggtctgcttggctgmaggttgtataagatgacaaagcattgatttagtgaattttttcacagttttgtgaacaaaaagcttgcatatttaataagtaagttattcaaatcttgaagaaatacaggcacgttctccaggcatttttagaaagaagagaaagagaatctatagcaggtggatatttccaactaggcaaaacgaaaagcacacaaagagttaactcaactgtataaatgaatatgctaatgaatgcataatttatctctgaagaaacatatttattgtttcactatttgattagatggcttcaatgttcaattaatcagttacctttcaatatcattcctgagagctgcttaattaatctgttgcactaccaccctattcatcctattagcaatccctcgtcccatttcaaatgacaaaatccaggaactgtgccacgtaaagactttatgtcaatgtcaagtgaaggttgataagtggctggctttttttctttattaggttaatcaaaccaatcagctttataggatttacatttgtcagaaaatgttaatgagttgaaactaatgagaaatagagggggaaaaccaccaagagaatggtggcacagtttatacacttcaacagcagtatactactttcattaaatagattgttttatcctcgttttctaaatgatggatttaaaatgtcctgctaattaaactcaaactcgtctattgtgttctatattgcatctcttactaacaaaggaagcacaatagatacacattcatatgtgtctttgaatcaaaaagtgtgctgtatgtttactactttctgggcactgtttcttccataatgttattaataatagttctaataatagttccatgaaaacttaccagtttgaaggtgctatgtacatagtatagagtagatttcaagaaatggttgagataccccaagacttaaatcatgggttgagttctttcctcatctgtttcatttaagcttgaaatatctctcttctacttctcttttcttccktttctcttactattgtctgatactccggataattcctcagcattactccctttgctctccagagcagggacgttttgatagaagttgcagcacaaatctcataccacctcctttaccttctcaatgtcctaggccaactttcattttcacccactacctcacatacacacactccttagcattctcagagggatttaatacactttgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaatggacaaaagtagtatgtaaatttagaagggtgggagatcagatttaaggcatcctgaggtcaaggtatatttggagaaaaaaaatactatttaaacttcgttcagaagaatgacgtagagttttaattaatcaattccaaacatgtagagggagaattaggatggggaagagaaaaagtacacccaaaggaggtaggaagggtgagtgtaaaacaggaaaggcagaatgaatagaaaggataaatagaaataagagagtggaaataaatccaaagaagtaaacaaaataaaggaaaaaaaaatctgagcatggtggtgcaaccctgtaatttcagctacttggaaggctaaggtgggaggattgctgtagctaaggagttcaagaccagcctggacaatatatcaagaccccatcttgaaagaaaaataaagcaaggaagcaagaagaaaggaaggaaaggaaggaaagaaggaaaggaaggaaatgaaggaagggagagagggaggaaaggagggagggataaagatgaagagataagaaaaaaagaaaagaaagcaagaaagagaaagaaggaaaatggaataagctgtcctgttaaagcacaaagaccctcagaccgcatagaaacaaactccagctatgtcatttctacaagagactaattaaataaaacacaagaacatgaaaagtttgaatgtcaagcctagaaagaatatgtcaggaaaatattaacaaaaagaaagcaggtctacaaaacaaaacagactttgagggaaaataaaagcattaaaaaagataaagagagtcamtaaataatgctaagaggttcaatttgttaggaacataacaattgaaaactttatttactgaatagtacagcttcaaaatatataaacaaaactggtttgatctatgaagaggcattaataaatccttcactattttaatacagctttcttggttattggcagatcaagtataaaacmatattggcaaggatatttgagatttgaacagcataatttaaaagcttttaggacactgcgttggtttgccaccttccccaagtcccaaattcaccccatatacactcccatcactcttgtcctgactttttcattggcttatctcagggtagtccttgatttgggtctgcaccgcaagttgtattatctgcctctggtttgtggctttactcatattctcaattttaccttcacagtttcttaagcaagatttctcccttccagtatcttagtgaaataattttttttcattttttgttttttttttcttccaaaaaaaaggatacatgtgcagaatgtgcaggtttgttacataggtatacatgtgccatggtggtttgctgcacttattgacccgtcctctaagttcctcccctcactcccacctcccaacaggccctagtatgtgtttttcccctctctgtgtccatgtgttctcattgttcaactcccacttatgagtgagagtcgaacatgcagtatttggttttctgttcctgtgttactttcctgaggatgatggcttccagcttcatccatgtccctgcaaaggacataatctcattcctttttatggctggatagtcttccatgatgtatatgtgccatattttcattatccagtctatctattgatgggcatttgtgttggttttgtgtctttatgattgtaaatagcgctgcagtaaacatacttgtgcatgtgtctttataagagaatgatttatattcctttgggtatatacccagtaatgggattgctgggtcaaatgaaatttctggttctagatccttgaggaattgccatactgtcttccacaatggctgaactagtttacattcccaccaacagtataaaagcattcctgtttctccacagcctcaccaatatccactgtttcctgactttaataattgccattctgactggtgtaagatggtatctcactgtggttttgatttgcatttctctaatgacaagtgatgatgagctttttttcatatgtttgttggctgcataaatgtcttcttttgagaagtgtctgttcataccctttgcccgctttttgatggggttgtttgttttttcttgtaaatttgtttaagttccttgcagattctggatattagacctttgtcaggtgggtagatttcaaaaatgttctcccattctgtaggttgcctgttcactctgatgatagtttcttttgctgtgcagaagctctttagtttaattagatcccatttgtcaattttggcttttgttgcaattacttttagcatttttgtcatgaagtctttgcctatgcctacatcctgaatggtattgcctaggttttcttccagggttattataattttgggttttacatttaagtctttaatccatcttgagttgatttctgtataaggtataaggaagggttccagtttcagttttctgcatatggctagccggttttcccagcaccatttatccaataggagatcctttccccattgcttgtttttgtcaggcttgttgaagattagatggttgtagatgtgtggtgttatttctaaggtctccattctgctgcattggtcccaatgtctgtggtgttaccagtaccatcctgttttggttactggagccttgtagtatagtttgaagtcaggtagagtgatgcctccagctttgttctttttgtttaggattgtcttggctatatggggtcttttttgattccatatgaaatttaaaatagttttttctaattctgtgaagaatgtcaatggtagtttgatgggaatagcactgaatctataaattactttgggcagtggccattttcatgatactgattcttcctatccatgaggatggaatgattttctgtttgtttgcatcctctcttatttccttgagcagtggtttgtagttctccttgaagagatccttcacatcccatgttagctgtattcctaggtattttgttctctttgtagagattgtgaatgggagttcattcatgatttggctctccgctcgtctcttgttggtgtaaatgaatccttatgatttttgcacagtgattttgtatcttgagagatacacaaactaaaattgtgtcctcaggatacagcttyaaattctatatgtttattattttattcaattttgtgttcaaatcatcctatgtgctatcatttttccaattacacagatgagaaaattgaggccctgggagattaaattacttgctcaagagagcacacctattctattaaaagggagataaaataatatttataatttttaaaaatataattctgaaaactctagcagctttttgacaagtgttttgcttttgttgtcaattaatactgttaccaaatgatactcttcttaatttattcatatccacagtgacgaattgcacaaaattatccaaaagattattaggtaggtctcatttagtggcaaccaagagtaaacaaactattttaagcaaaaagataatttcttggcatgaagtactaggaagtacaagtgtacagatggccttagacatggctggatctgggtactgaatatgtaatcagaatattatctctccccatctccccgcatgctttcctctatattaacttcatttttagacaggggagactgagtagatcacagttttaggaagttgaccctgagtcggtctgcctgtgtgttccagtcctatctaattagaaacagaggttacaaataagttcttcaacattgtttatttctcaatagcacctagaacagtattggcacatagtagatgctcattaatttttttttttttttttttttttttttttttttgagatggagtctcgctctgtccccaggctggagtgcagtggcgcgatctccgatcactgcaacctctaccttccggtttcaagtgattgtcgtgcctcagcctcccaagtagctgggactacaagcaccacaccacagcgcccagctgatttgtgtgtgtgtgtgtatttttagtagagacggagtttcaccaggttgaccaggctggtctcaaactcttgacctcaagtgatatgctggcctcggcctcccaaagtgctgggattacaggcgtgagccactgcacccggcctaaatgctcactaaaatttattaactgaatggcttatgtgaagaaactcttgttgaattactggaagaggttaaggcaaacacctgtctttgataatacttattctaaaatgttatttataagcttggttatatgtatagtgagattttaccaagttatgatttgtataagaaaacatttggccgggcacggtggctcaagtctgtaatcccagctctttgggaggccgaggcgggcggatcacgaggtcaagagatccagaccatcctggctaacacggtgaaaccccgtctctactaaaaatacaaaaaaattagccgggcgtggtggcgggcgcctgtggtcccagctactcaggaggctgaggcaggagaatggtgtgaacccgggaggcggagcttgcagtgagccgagaatgcgccactgcactccagcctgggcgacagagtgcgacaccgtctcaaaaaaaaaaaaaaaagagaaaagaaaacttttattagagataataagttcaaaatataaacaggtaaggtagaaatggtacacacgaataacaaacataaaagtacagatggaactgtgttaggaggcaggactcawctctggaggtggagctcagataccagacaaaattgaggactaagacaaggactgggcggaagtagctttcctgaagacatgctcactagtgtgccmtgtcagtttaccattgcaatggcagcacctgcgagcgaccaccgcctttccaggcaataacccgatgacccagaagttactacccttttccgggaaatttctacctaaatcaccccttgatctgtattaaagtaagtaggccaggcttcacacctgtaatcctagcactttggaaggccaaggcaggcagatcacttgaggccaggagttggagaacaggctggcaaacatggggaaacccatctctactaaaaacacaaaattagccagcccaggcctgtaatcccagctactcgggaggctgaagcatgagaatcgctcgagcctgggaggcgaaggttgcagtgagccgagatcgcgccaatggactctagcctgggcgacagagcgaactccatctgaaacaaaacaaaacaaaacaaaacaaacaaacaaaaaagtaggtgtaaatgtgattgcagacctgccctgaactgctactctcagcacactgcctatggggtagccctgctctctgcaggagcagtcacaagagttgtaacactgccagagctgttaacactgctgcctcgatacaactgttttcttctaccctaccaccagcttgtccttgaattctctgctggacaaagccaagaacagttgcggactaagctccactgtcctgcatcagaatggcttcaaaagttacaaattgtcaatgacaaaatgtaaattgacactaataagttaatcacaaaattgagcccttaaaaatgatttcaatgttatattaggaacaaagcttcctttcctgctgtttttctatgtattcccagaaaaaaattcatagtttgtgtgataattctttattcaagcttgactaaaacttataagcaactacatagagttaccttggactcctctttatcgtttaacatgtggatgtaacattcaacccaaactcattcaagtacagaagggtgatgttttcttaatattagtacagtagagttcatagatagatgtttttggctatgttataagcccaaaatggcatgattaaagccattttacatttctctgcatgctggagtattttgtaaaatggctgtttctaagacaaatgcataagagcttctgcgtataatgaagccatagtcttcaggtaaaaaagaaaaaaaaaccctctagttaggcaagttttctctttatctgaaggtttgtaagttcaaaattaaccatttaaaaatgatcagaagattttaaattaatgtacgtttttatgtagcacatgcaaagtttaaactgtttcttagtgacttaggagtgatcatcatgactattaattacacacagatgctgtcctaggctcttttcaggcatttatgttgtaattcatggtactactactgtgagtcctccaccctccattagagttatttatttatgctctgccttatgctaaaggacttaatattccttaaaatacatcttaaaagatttttttctgtgtcagtttgccaagaataatggcctccagctccattcctgtccctgcaaaggatatgatcttkttcttttctgtggctgcatggtattccatggtgtatatgtactacattttctttatccagtctgtcattgatgagcatttaaccaaatactgcatgttctcacttataagtgggagctaaatgatgagaacacatggacttatagaggggaacactctgggcctattagaaggaggagggtgggaggagggagagcagggaaaataactaatgggtactaggcttaatccctgggggatgaaataatctgtataacacacctccaggacacaagtttacctgtgtaacaaacctgcacttgtacccctgaacctaaaagttaaaaaaaaaaatttttttttaaatgttaagaaaacgaagaaatcaggacactgatgaattaagtagaatgaataagacgaagctggggacgatattagtacacaaagtacatgttgtgaactgctgcccatatgctggaagaaggcacacatgactagcaagcccccaaaacagggagatgtcaaatgggctgcagttgtttgtgttcaaaggtgcagaagaatcagaaccatttctsacactgagcaaaacttcccagggtctccacagcttcccacatgttctctgttttacctggaatgtccttccaccactctccacctggctaactctttttgaaaacactgttcaaaaatccctcatccgtatcctgaatgtttagttacctttctcctccatagtgttgaaagctcctcaatggagctttccaatggagctcctcctaataaacatgctcattataaatctaaaaaactagtttcttagagctatttttatagcttttcctactgtacacacacttcaggggaaaaaaaaaaaaaccagctttatagttgaactaacacagtgcaacttaacacctgcaactaggggcctcacttcattcagagatatattttagcaggttagatatattgcaaatcattatacaactgtaggaaattattatttcaaccaaatatttgatatgtgttaagcaatgatgaatttgaagttactttaatgtatcttgagaacagtgattctatgttgcttctttaaatatggagcaatttactttcctgtcaatggaactgggtatgacattgacttttgtaaggtacgcaggcatgcacctgtacctgggccaaaggagatcctactccagcatgcagagaaatgtaaaatggctttaatcatgccagaaataaaggctgctctaattggatgttttgtctttgatattgtctctttccttgattaagctattagctatcacttcttacaactctccaaatacttacatactcaaaaatttccatgtgtagtgtaagttagattagtaaactagatatttaagcttattttaaaattatctaagtaaaaatatgatgtacctcatgtagacctaactgaatacattctgatgagtatgagatggttaaggtggatattaaacctgcttttctgccttgagagctcttctaccactccacatccagttactcaacaagctacagcatttcgcttctgaaatagctctgctcctgttttttagctgtctctttatttgggggcttatgtcatcttacatggcatattgcagaaataccctatttggtctctctgtcattacccttctaatccaacctttacactcatcttttggatacctttcataaatgcaaatctttctataaatacctaacaaccttggaataaaagccaaattcttttctcactcagttattcacacaaatttttgttatgtgtcatgcattgtgttggatgcttaacaacacatgcgaaatctttccaagattgtctcccttgcttcaactcccagctttcccccactcatagtctatgagtacatttattatccagaagtatgaactcctccagaatgcagaatattctctcatatttccaattgtttgcatattctggtgcttccgcatgaaatattcttccctcttgtccttttaagactcatctcctctgtaaagacttcttgtcacttcttcccatccttaggcagagatagagactttgttttggtgctcaaatagccatgttttcaatacttgcatgataagtttaatcatggtgtttgtaactttttgtgtccttgcattattttttctaatagattgggaagacaggggtattatcttgttcatcttgtgtccatgacaaatagtacatgttcagttaatgtctactgaagaaattactgagttatcacctgcctgctttcggtgggcaataaattgatggcactaccatggtccaagccctattgtatgtcatgtttatttgcaaaattgccttctaccttcccttctgattagattgtaagcccttgaagatcagggagttattactcatgtgatacctagaaaaatgcttagcatgtagtaagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaagggtacactttcttcaagtgaagattctgagggcagaggcaaaagaaacacagagaaggaaatgaataccccttctcccatcataactcttytctctgccagtaaatttgacagaacttgggaaatatttgggtacagagatgtagaaaaataagtgaaaatggcttttcaatttttaattacccaacatgccattggtgaagataagaattaaaggaggattagttttcacatttcttttcattgattactactttactgatatataggaaataaaatgataaattgacaatttagatatatgttttcaatttaaacatcttgaatatgaaatgcctaagagatatatagatagaagcttcaggactttttagagatttcaagtaaatatggtgtgtgtgtgtgtgtgtatgtgtgtctgcatgtgtgtggtgtgcgttggggtgaatgtattactatgaagtataatacaggggttaaaatctcacatatctcacatgttccagacagagaacatacatacataaagcaaaaccaggatgggggctgataggaatatgtggctggacaaaagggtcagtagctattaagctctggttgattactgccaaagaagaatgcaggccagtgtgaccaaatttggtgtttttccaagagaaactggaaaactatatttttgttcgtccaatgtcacatgaatatctgcaactaactaaaaattgaaattttatgatgtccaaataaaacacatatataaggcaaattcagccccacaggatactagtttgagacctctgaattaaagtcttattgggagtaaaagacacgtaacatgttaagaaattgaagagtggtctaagccattacataactggaagtcaaattaaataaaattaagtgtcaatggataaacttgtaagtattctggaaagggagagatcaatgttggttgaggtttaaccaaaattatgtgaagaagtggggctttgcctgaaacttgaggaatgattggctatcattggcaataaacaagggagaaatagagatgatgcttagggaagacagtgagtagcttattcttagtggaaacaaagaaagaactagaaccatttctcctaactcctggtttattgttttatcttccatgttctaccacctcctatttgatcttggataaaacagggatacatagaaatattaattaattaagcaaatatttattgagcacctactgtgtgccaaacacttgtctagggtgtaaggtacagtatatgttaatgctgtatacatgctttcccacatagagaaacaggtcagctccagcttttttacataaacattcacactagatacactttaattattctagaaggcagggaaattatttgagaattttcataatcctggggaaatatagtaaaaaataaaattttgaatatggacrtactatatcaagagcaaatagttgtgccaatatttctagaagcaaatgagtattaaacaatatcttgtttatctaaagctaataaaaatttagaaatgggtagccaaactaaaatagcaatttgatcagctaatgaacacatttcattcaacagccattgaatgagtacttatcatagggacaagtattaaaatcaatgtaagtaatattattatactttgttccttggctcttatgccctttgataaggtggcatgtggatttggagagaatagaaaagagaaaaagaacaaatattttgaggagggtgaaactgatgtgtgccaccccaaatctttgwttatatattttatgtagcatttcattgtataaagaaataatatacatgtataaataattttttaaaaattggatttctagtttcagcaaatgcctttatgctctttttaaaatatgacagtctggtttacaattgaagtacattatgtatcaaaggacccatatttgacagtgtacaaagttatgcgtttaaaaataattacactgttaaccaatgaatatgagttaatactgggaagaaaaactttattcaagtgttcattgcccatagcaaagtaaattatagaacagaaagttaataaaacatctaagttgatgtttcaaactcaatattacttttaaaacatcatcaagcagttgaaagccatgccaaagagattagttaaaggctaggtgactgaatacgatatatgtacttacaaagctttcattgcatagtgacattctgttcaaaacatactatgttgctggcctaacctttccatctgtttctcacagtcttcttatccaggtagttttccaagacatacggaatattagctatgcactctctaaatttaccttgagagagatcagatccatatcataagaaaaataaagtgtcagcatgaccatcttaaatctgtatcttggatattatttttaaaagctagtctttcatagctgacgtactacataacaaatacaatacattttaaccttattttcctgtgcaccttccacaaatccatactgcaatcacgaaaagggatacaaatcaatattcacttaataattttgattagaaaaggtataacccaaaggaccattccagtattgaaatttcagtaatatttcacctccctcagtcctatttctactgcatcagcacaacattatctcagctagcagccattaagatggttttctctttcatgttgatgctcttgcatacattttacagcctgctctgatggaatttttatcttcgcaaatgtatttcctaatttgtctatttctgtgtccagtaaactttagtctatagactaagaagtcaaaagttatagctacctttaagttacataactttagagacagaattttctacagtgagaaatttaacatactttcttaaggcattttggtgaacaataaaactttcttgttaaatttttgctttgcaatttacaagaattgggaatttggggtgatttgagaaaaagaggattattcaatggataccacctgcatcataaggctagactaattcttttgaaaggttaaaattggcagttactttaaatgatcttttgtcgacttttggaggtaacacagatgtctactacatttttcccagtgaatgtgttataaaatttaactgtagggtagtgaggctgtggattcagagacataataaagctatttggaaatctgggagattttgttttgttacagtagtattttccctgaagtcccttagtcaatagaaggaatgcaatttcctaggaactgcagattactttatatgggtgattgacaatttataaaacttgcatctttcctaaagaaggtttttatattgcacagatattttgttcaccacaagcaagattaaaataagctaatgaaatatgcaacttgttatttcacatttagtgactatgaaataactgctgctctcaaagaaccaatctgtcaacctccagaggactaaatagtgcatgggacaggggacaatcataacttagctagtcaaatgcattttttgtcttgtccgactatattattagatagtattggtaaaattaagatttttttaattaaaacttttactaaaagcttctatttcaaggaatttttgactatgaaatggaatataatggatcaaatttttaaaatattaataggttaatatttttatattgtgcataatcctggttcccaaacagataaaatttctatatacaaagagtttagttatggggggtaaaatgaaaactttaaaagaaatattttctatttaacaaagacgtacaggtgactcttagttactcaaggcaggacaatctcagtccacaaagagattgtaagtgtgtttgagtcaggagcctagtttttcctttatattttctccttcataattataagcatattaggacaaataacaactttttattgcattgggggctcttgaaataatgtagtatgttttctaccatatagaaaactatattttatcataaaaacagaaaagttttagcaaggagtaatccttcccagaagactggatctgttgattaacagcattttaatgtgaggactctgtctttgcaaaattaactgcagataatattatggtggaattagttgacaagagatgaatgtataagacaacagtttggcagaggaaatattagtatgcatgccatccttgaagaatattttaaaaatataatttacataaagatcttagtggtaggatttaacagattttgacagatgcattcaacggtgtaaccaacaagctagtcaacagatagaacatcttcgtcacccaatctctttccagtcaatctcccctgtacccagcgcatagaaaaccagtgcttccatttttatcatcataaattggctttgtctgaatttcatataaatgaaataatatggtatatacttagatattgtgataatgaaataaatgagaaaaaatagtatcacttagaagttagaagaggcaaggaaagtgttgtcaaaatagaaaaggcttgtgtatattgttcatgagctcaaggaaaaagatctgtggcaagaaagagctaaaagattcaaaagcaggagtagcaacgatgtgattttgaaagagtaaaaacatcttttctgaattgaaggtaacacgatgtgcaaacataaattcgtagtggtgtcagtcaacactgttacatgacctttttcagaaaattctgagctgttaaggagtaggttcagaagaatcagaagacatgatttagtcaatgttagtcatgggcaagatgggttcagcagaagatcagctgtggaatgataattagagccctagtaaaaatatgtagagaaaaagagataatagtaaggattgaaggaatggcatttactatgcataagacatttctgctcactgattatatgttgattggactagtttgttaccagttttagcagaaaatctgaaagtagccctctctagctcatacttcagttctctttccagctttaaataattaacttgtttacttgaatctatcaaggttgataatcctcagcaagtttaggaaatgttttacttctcctcctactggtttttttaagtttctacacctactggtattgtagataaacattagtatgtatttgttaataaaatcttctttcaaaaaatttgaaatttttacagtttttcatccttcacaaaagtatctatatttcagattaaatctgaccagaagtctagaccgctgtgcattgccagaggtaaatagattctgactttaaacacaaggaatgatacagcaagaaaaagacagttgttgccctagaagcagctctacaatgacatcactaacagtgatgctggtttctaaattgtcatctactccataaaacattaattttgcattcatcttttattgaaagcagtccttatacacagtttctattttaaaaatatctattttttaaaatttattgtaccatttatttcttggcccttaagtgctagctcaaagatcatgatgacttattatccctgctccatgattatgtcttcttaactgctcaacaatttggaggagctcctgtccttgtgggtctagattcccccaattttcagtgcttgctccacctagtaagtgtctttctgtgcatcttgaatgttctccaagagagcgtggatgaataagccagtgtcactacatgcttaagtgcaaatagcagccatttcagcaatcagggacaagagatcaggcaaaagcattctttaacattgtgcgatcttcacatttttatttaacgattactgatttattaaagctgcatatgttcagaagattctgttccttgtacaagaagtgtttaagtgcttttcttatatcaatttgttctttctggaatttttttttaaatcttctcttccaagcttcattagttatcaaaatcattctttttcatgtgccaggatgtggcccaaaggttaacttgtccatctaacttaatcaagaggtgactgtactctggtatccctgagacatgcagaattaaaaggttataaaccctgaatgtttagaacattgtttcagcacatattaattagtgacaaatgacctgaattgattctatctatatccagttcaaatgagcaagcagatatttgacttttagcttctaatgctagaagcctggatgttggatttttttttcacaaggagactcagtgtctagtttcaacagcttgaacaagttaggcttttgattttatcagtctcacacagggtgagcagactctgcagaaatgacttacattaagtaaggctgtcagaaactgatttatagagcaaaatggcattttatcaatttgcaggtagaagagaaagagaagggactttgcaactgtgtagaatggagtttaattctcaactttaccatttaatagctgtgtaactttggagatgtaatttaatctctttaaatttatttttcccatttctaaaatgagtataatacatattcaggactctggtgagaattacataggctagtatgaaaagtgcctagaaacctctctggaatatactatgtgctaagtaaatattagtttctttttcatcatttctattgagaacagaaatgtttatctagtaagagtttggtgcacttgtgggtggattccttcagaatgtcagcctacaaattaaatagttatttcgtgaacatggaattacacaaaggatgatatttttatctagtacaggattaatggattgatcttctttaacctagaaatgtctctgcgtggattgctggtattgaacattattagccttaaagagcctcactcatggagaatgtgagaggcacacagggaaatgttgactatacggcgctcctttttaaatactcctaatgagatgttaacttctcatattataatcttacttagaagatgacattcttagtttatttgactcctaaacttttgggacgagtacttaattagaaaaatattataggatcttcaatgaggtttggagataccttaaaattatcagaagtgattagggtgtggtttctacattttcatgttggttcttactgactttaatttctgatgattttcaaaccctgaaacttattttgtatcttcagtgtacatagttaaaattacacttaaaaacaattaaaatgaggtatctcattttgcaaaatagcactgtggctcatgtaatactatacatttttaccactactgccttcaagcacttataaaacttctttcctcatttttcatttctcatgttcagtatttcagttttgttgacaactgaaaatgggaatcagatttgaggaatcccttcaatgtggttgatttttgccccatgaaaaagaagtggtaatttatatcaactctcaagaagtttaggcaaggtgtgggatgaaggcaataaaatcataattataatatcatgtgctaatgtggaagaacaaattttgagtgtagcmataggggagcgtctgattcagactaaacatgtacctgcaaattagtcaagaaataatgagacaatctgttaccaaactctyggctttgccgttctctttctctggcactactacgaaccaagataaataattatacaatatgtaataaagccaccttgttaattgccacttaataaaaataaattagtaaaaagtttggttaatcaatcattggttcattggttgcttcaatagtaaggctgagatctgatggcatggctttgatggtccacattcttcccaagtgataaatagtaaactcttcttttaatcatcagactgtatttatagtcttgactagcatccattcaataatattaatttgtcrtaaaagaatatagaatatgcatcattttgttagcctgtcagcactgcaggaaaatcagctcacacatatgtcatgaagaagatggtggtttcatgtccctggttggcagtacatgtaaggttgctggtataatgtactttgccatttctgttccctttctgaaaaagaattccttactaccaaggctgcgcaggtccatatgcaatgaccaagagtacayaaagataatgtccagttcagttcagttttgtggtgtgtttgtatttaaaatgtgaagtagcgtgtctatatgcattcatgtttatttgaacaaatgctgtaagtcccctgcaaccttttagttaagtattgtatttttctgcactagaactttatttgatttttatttttctgatttcatgtgctatttatttattaatcttgagcatgaatgcttatgtttgagcatagttagatgctttaaaatccatgcataataattcaagcatttgggtttcaaaagaaccagttcttttgaactggttggtcattacctgtttacagtttcttttgattggtcattatatgtgagcattgtcctgcttcttcatatgtgtatcaattctgtatcatacactggatattgtgaattattgtagagactttggattctgttatattcccccaacaagtattgcgggttttttgttgttgatacttgtctgtttaataaggcaatcaattcaatactttgtgaccactgcggtaggcagcagttgaaatttctattcagatgttttagccttagtattttaagagtctgtactgcacagttcagagttctgctagatattaggtagagtttacacacagcacttgtccttcttctccctccaattctctctttttcagtatttcttctcctcgctttccaggtgctatggtggttccaaactctatttcttttaaaccagtgacaccatgaacattatttatataaattgaaggcartggagacagaccaaaagtaaacagaamgtagaaaaaaattaaaagtcaaaacctagaaaatgaatggccctaggtgagtttgggtgagtttcttgtttttacaggatkttgtctgaggaccaaataaataactaaatgtttgtacaaaatgtactatatatacatatttattccacaatttgtagcttagaatttgtatctgtagggaagttggtctatttggaactctgaaagcagaactccactccaaactttttaactgctgttatcaccttctggaatatgtccttttaatatccctcaaatttatttcatattatcccagtttatcaaacatttaggacccaattgtagtcgtaaaggaatctttttcttactgttctagctgacagtgcaatcatcatctcatattggaacttaaattccctggcttacttcacctctcagagccccagttttcaaatctataaacacagaaataatcattcttacctcataggggcattatcaatattaataatacaatattatgcatgtatgtatggtatattttatattaatataatatataatagtaacataccataccatacacacacatttatatacacacatatacatatatgtgtgtgtatgatatgttatatacatacacacacacacacacacacacacacacacatattagcatggttgatacctggtaactattcagcaaattatgggtgtaattatgggtttaacgtctgtctacaatttttacttaaattgaaaggcatgcatttttcaattgctacctaaagtctcagaaggctgcaatcaagtatgaaggccaagatgagaaagagtttatgcatttacttgataactcaaaaaaaaacacatatggtaaattattcttttgtgccacagtaaatactgaatatattggtgtcaagcaatggcttaattaataggataagaaaccatgttcatagaagttaggaaacaagtgtttaggggttaaattataattaaaataattgacctcttaataactgaaaatggtctgtacctaaaaagttggtataaagttattataagtaggattaactatcattcatcagcattttgtaacactcagatttgaaagaaagagaaaaagagagcgataaacaggatttattcacaagagaaccttctgtggcattttctgaagattagaaataatcagttctaactcctaagacaacctataagtgtaaaataataattgatatttataatgatgattctgagttgcacaatttaactcatcaaatatgttcattcccttccatagattatacttaataagccaagaaggggattctcaatcattttcaaaagatttttaataaggaatgaaattttaaaaatgttttcctccctggtttactttaaattcatgaggaaatttaatgagtcagatcatcccatttccaaagcattgcactatttgttagggtatacttttttaaacctccaagctgctctgtgaaaggttacatttatttttatgctaatttcctgtccttacactcaacttcaactgccaaaaaggaatgagactgaggaaaggagaaagaaaacaataggaaagccatttattcttatacatgtaggtcaacttaytggtttatcgtcatttaatttgaatgtcacttggaagattttatagtgtggaacagatcgaagttgaaagtgtggggaataaaattttttattgttcagtaactaaatagttcttttttggaagccggaatttaaatccagtctggtcaaactgttaaaagaaaaagaaaaagtaaacataggaaaaggaaatttatgggatggaaaaatgtcattttctaagaacttcttggttgtaaaaatcctgattattatcccacaaaaaagtgcacaaatggaaaatgggtccaggtaaaaggggtcaagtttagcaagacaaatttgatggtgtggagagcttccacgtaaatacgacttcattttagattagttatgttctggggtgacgtctgttatggtgagatagctcacaaaattggtgctggagctgatcagctgcgaagtaataagaaaataattcattttgtgtttttaatgatattattggattaatcatgaaaaacractttttggtttttttcaaatttatttattttaaattgacataaaatcatatgtatttatcatgtacatgatgttttgaagtatatatgcattgtgaaatggttaaatctagctaattaacaaatgtgttacctcacatagttatcatttttatggcccaaacccttatacatccactctcttagcatttttcaagaatacagtatgtcattattaacgctagtccccatgctgtacaacagatctcttgaagtcattcctcctaactataagtatgtattctttgaccagcatcttcccaaccttctctcccaatgactaccccagcctctggtaaccaccattctaccgtctatttctgtaagatcaacttttctagattctacrtatcagtgacattgtgcagtatttgtttttctgtgcctggcttatttcactgaacgcagtgtcttccaggttcatccatgtggctgcaaatgacaggatttccttctttcttgtggctgaatagattatcaccctcatgtaggcctagtttttttgtttgtttctttgtttgtttgtttttttaggcagtgctactgatgctcattcctttatgaattaatttctttatttgaacttttctggttgggaaaggcaatatacatagaaatcactaatacctgagaagaattcatttccctaattgcttccttttatggaagaagacagactgggaaagctttaaattctaaagtttaagtcttttagggcttgacatgacatcacatacccctttggaattaataggaagacaagttgccttgataatcctaaggttatcatttctgctgtgaagcaggacaccagcagctagcaccctcttaattgttgtatcaacttaagtgtatgtaactcatttcctcttattctgtctagaacaaagaaaaacaatgtgacaatatacctgttttatgggtctagaaactgaggagcaaataggattgtaaacatgaaaagatcattttcaggcactttcttgttccaggcaaggaacattcttgtacggattgagatgtctgaaaatcaaaacactgagtaatttaccaaaggttatatttcaagtagtgagagctagaacacacattctcaagtacagtggtattttattgccaccaactactgtctgatcttctcaagattcctcaactttcttatctgcaaaataaggacaaagataaaaatatttaactcaaaatataattagcatgattcaacggaataatgtataaaaatgattagtggtgctgtgtgtatataagataataatgctaataaggtgggcccatagtaattttttaataactattctcttttaatacaaaaatatatactgcaagactcacatgttggttggaaatttccctcaaatcacctactgattacccttgatttcccattgtttttagtttctcaaaactaatgaaatgaaatatagcagaatgctaacccatataaaaataaagtgtacccaaatattgtaatgtaaaaaatatatatatattcatatagtagagccagaagtggagttcaagcatgtttaaccaaataagagttttaatttgcagttcaatcatgggttcaaacagcccatttttggaccacaacaacatatatgtctagcttactttaattaccttacttcaaaaagtcttgatgttacaagaaaatacctgctttttaacatccaactcccttctaccagcatgwtcttacttcctccttctccagcctgtatcccatggtcttttattatagttagatccttacaaactataactctcttgtcctttttatcttccacttttcttacttagcaaacccaaacctctataaatccagctatctgcataccctaggcttaaatacaaactggtaaacatagctggataagaattactcaagtattatgacaggtttcatacaatgtgcatgaccataaacctcagattaacacacaccacagctcagaaaccctgcagtctggctctagtgaattcctttgttatatgcttagagtttctctcaaagcacattatgactaaggagtgtgtgtatagggctcccatccacaggatttcatggcacattccatcttctacaccactctaacccactgaagtcctagaaaggtatttaggtcaattaagccactagacaatgtgagctgctgataataaggcagagccagacagttttgttttgtttttttttttaaagttaaggtggctgccttcttgtgtctgtcacatctaattattcaaaagattactgccaaggttgagccatgcttttaagggtcaaccactacataattaccaactccatcattatgaatatgtacctgtggttccatcagtgcctgtgggtctatcactaccacaggtagtagctaaattttgtagcatttggtttcattctcagtaattgggaaagtatcctttgaggttttagcaattacccaaagcatatgctgtttttccaacaacatcaaatagattatgtagactttgttacaagaattttgatgctgttctgttacttgccctcccataattttgaattaaagatgtaatcaggcactgaatagaactgttgatatgcactgtgcatgtcaatcctctctgtgttatgcatgaagcaactttgtgtgtttgtgtatatggtctgacttcttccataaagtaattcttagactagattgaggttttatatgaaaaattttatgagaatatattttttctggttgcatgagaggatgttcagtctgattaaattgtcccagaacatgaggttactacttaagagatttaccgtaaccttatgtaacttcattcattattggtctaatttgctaaaaaagctctgyctttactgacaaatggaaatattcaggcttaagccttttcttgcgaaaaaaaaagagagagagagagagcgagaaagaaaagaagctttattatcattttacattcaagggcaatctcttttttttacgtatgaaagtaagtgagatmcatctactactttgaaaatgaagaaagttgagatcattgacaatgaacatactataattttaaatttaaatgtttaatagtttacttattataatttatttataagaattactgtctttaaactactattggcttactagttgttgtttttttgtcacatataaaatgctttactggttccagttagtatatttattcaactgccaattaaagattatccctgtgtaaaaaaaaaatgaataaaacaaacaacaaaaaaaatcatcctgtagcagctcaatttgagcaaaaaaaaatttaattatctaacaactatgtggttgagatgtggctggtgggttcatctcatcatacagttcgaatatatagccagcatcacccatttagtccctgcagtggctgaaaacctggcaaggctttttctaacctgcttttctccttgaagatatttgcttacattgtcaataggctaagggggttgttttgaagcctggattttgaatttcaactgtcaagcatagtctattaatgtagaaggttttaagtttatagtttcctcaatgaatgcattttaaaatggtacagataactctatataatatcctccatatgaatttagtttatatgctagcaaaatttaaatgagatttaaaaaatattctggttgctctgaggagaaatcactcaggtaaatctagaaaaataaaacagtaaattgcaatatgcattctgttcatctgcttcagttgtgtacttgcttgaaactaatttgctggctatgttatcacttccctttaaaatggtctttactgagtagagaaaatatatctgtaactttttgttaattggcgcataagttttaaacacagaagacttcatcacgaacacataatttggtagtaaaatttttttagcatcaaatgtatctactttataaatttcatgctcagcaaaacatttgattatttgaataagtttaaggaaaaacacttttttaatgttgtttctgactattggactagtttttaaaactggtagctcatatctgtcatagcttctcccagtttctcaggaactttacacgcttgtgtacaccctttccctctgaactggatcctggcccccatcatgctcttaaatgtcccatttaagataaaaaatagatttccataactttaccttccccaactcttctatcaccttcttcttccttcctcttttacacccaaactttttgtaaatagctatctataactgctgttatgtccccacatcctcattttctatgcatacctttctcctgagggtctaattctatttcaagtttcagccctccacgaaaatgattcctcctaagaccaacaatggcctgtatttctaatccaatgggatttctgagttttcattttcatgccttctctggtgcattccaagctattgatgatttcttctttgaaacaccttgttcctgtcatccaacacagggcacaatactggtttctttcctaatcctgggtttcctttgctgctcactcatctacctacacttccaatgctggaattccttgagcctccggcatatgtttctgtaccagctctcttcttcctctaaatgtttccattcacaaccatgactaccattgttatgtctgtgttaataatgctcaaatatatacctctaaatcaaaacacttcactcatgtccaaacctaaatttctcctcagaatgtctcatagtttttgcctaaatttattatatcccaataagtaccccatcttctttcacagacttctgtcttttccatcttcgccatctctttactggttccagttagtatactttactggttccagttagtatatttattcaactgccagttaaggattatccctgtacgaaaataaatacaatgaataaaacaaacaacaaaaaaaaatcctgtagcagctcaatttgagcaaaaatatgccatctcagtaagtggcatatccacctttggttgctcaagccagaaacctagaaaacatttgttcacctttgttctttcgtttagtctccaaagacatatacaatttcttcccattttaagtaccatgtctaaaatgtttcaaatgttgatatggtttggctgtgtccccacccaaatctcaactccagttgtatctcccagaatttccatgtgttgtgggagggagtcagggggaggtaattgaatcatgggggctagtctttaccatgctatcctcgtgatagttaataagtctcacaagatctgatgggtttatcaggggtttctgcttttgcttcttcctcatttttcctcttgccactaccgtgtaagaagtgccttttgcctcccaccatgattctgaggcctccccagccatgtggaactgttaagtccaattaaacctctttttctttccagtttcaggtatgtctttatcagcagcatgaaaatgaactaatacaaatgtatatgtattttagaaaaattgaaaaggaaaattcccttttatatttacccacatatttaccttttctaatgctcttcatttttttcagaagttttgagctcatttggtattaattcccttcagtttgaagaactaactttagcatttctagtaatataggtctatctgtacatatctttattttgctttcattctgtaaaatattttttgttgaatacataattctagctggattgatatttttctttcagtgctttaaagatgttgatttattgtcttcttgcctcaattgtttctgattattctcttctatgtaataggtcaattttctcttgcccattttaatattttctgtctttgttttttagaagtttgactatgctgtgcctaagtttggctttgttctacttaaactgcttgggatttactgaacttcttaaacctgtaaatttgtgtctttcaccacattgggggaaatgttggccattatttcttctgcctcattctctctctactctcattcttgcattgaagacatttatattacaacttttggtatcaatgctcagcttcctgaagcactgatttttttaatgttttttccactttttatatgtaatatgttttatctctcttgaagtttactgattcttcagtcattttattctgctattaagttcaaatatacagtattagatattttaaattttactcatagacttccatttgtttcctttattataatttccatttctcagtaatatatcttctgtattaattcattataagccattttttcccttgatatcatgagactagcatggtaaatattttaaaatagtgtgagctaattctaacatctgtgtcatctttggatcattctcccttgattttttcccctgaaaattgctcatatttctctgtttcttctactatctagtaattttttatcgtatccttgacattttcaatgttatgttaccacttcttgggattctgttaaattcatctcaagagtgttgaattttgtgtatttgttgtaacagccaattaagttagattcaaggctgctgttcttgtgcagcagcttaaatttttgttatgttcttttaatcttctacaggcttcttggagtctgttcatgcatatatgatttgaggttcagacagaaatttggggagagtttatttacagaattttatgcattgcctctatagttctctcctctccaggattcccccttacaaaatttctagtagctgaggcagcccctctcaagtcagaaagtcaagattttttaacagtgattttagttatctccatgactcccagtgcagtccatacacatacgcaaacacacacagaaactcaccagtgccattctcttctcccaagaattgacaaccctataatagaatcttccactggttatatttcagtgcttttgagcagttgtttcttaaattttttcatgtgttatagttatctgtgagaggatcagtacaataagagcttttctagtcattactaaaggtaaaaactaaactctgcaaatatattttagccactttgtatacatttataatacttaaagagataataaaaagaaaaggttttggagaagaaatctcaagattgtgatttttttggaaataaatattttacgggaggcatgaatgatgatttagagttctctgagcttataataaataacctcagattgatttggtttttaagttctagaattaacatgtataactttcctagtgccacttatcaccctcctattttattggtgtatcatcaagccagtcactgaacatttacaggtttttaaaaagaatgtattgtgtctagtctataacagatttaggaaacgagataatagagcttgatagaagtgtatctaaaataataagtattttcacagtaagatcacaggaaacttttctttaaataaaattcatattctatctgacttcaaaattttcattatgtttggtaaaaacaaaattagaaaacatttcttgtagtttgtgtgtatgcaatatttatgacttatggtaattttctcttctagtcattcatgttattaatagaaaaaccttaccaaaatgaggcaaatatatactacaggataaggtcagaaagtataactatctaaaactggtactaacaaaagtcagcatggtgaatggagatagtttactttttagttgatgagtttaagaaaccttcctaaatatcatcaaaataactactaaaatatcatacataaaatacaatatttaaattgctaatattttaatgacatgaaaatgcttggagcacagcagaaagcaaatggaacatatgaatttctggcttttcacattattttctagaaagagagacaacgagcttcagacatgcttttagaccacttgacaaaaattatatgtatacaaacattgcatatgaagtctgctttagcttgttaacattctttataatgaccatcatatactatttattctgcctgcatgccttcatgcaacttgccagttcattcgcatctgcttgtcagtttcatgattttttggaaaattagctgttgagattttgaattaaatagccattccctatgaacttacatggtgtttatcagtcccttaaaatccaattacacatactgtttatgtctgcaaagctttgaaccatacgttatactatgggaattcaatttatttgtgaccagtctaccactccctacacacaaagcacaaatcaaaataggttagcctttatttatagcatctttacattccttaatttccatccaaacaatctgaatatacacattttggcataatctgttaacaaacaaattaatgatgccccccaaaaaacacacagttgaaataagaataatttaaaagtttattcattcattgtcctcaaatttatttggattacctgaggtctggagtttgagaccaacctggccaacatggtgaaacccagtctgtactaaaaatacaaaaattagccatgcgtggtggcacgtgcctataatcccagctactcgggaggctaaggcaggagaattgcttgaccccaggaggcagagggtgcagtaagccgagatcacgccattgcactccagagcctgggcagcagagcaagatgttgtctcaataaataaataaataaataaataaataaataaataaattgctgctctagctggtgttttttaaagctcttgttgctggagtgtttgtgtgtcaggtgtgtatgtttctgagtgtggtgtgttaatattgtgaagtctgaaatattttctaagaggtggtttgagaatgaaacagaattctgcacctttgactcaacagaaaatcatagtgctcagatgcaagtccctccaaagcatggcttcaccatggcagtcatctggaattgttgtagggacatgctaggctaacatgtagcaaaacagatcttggggtgagaacttatgtcttccccatccatagcagaaagctagactttagtttttttaagctgttatttgctattactttgaactccctgtaaaatttatgtaaaatttcacataaaaagtattttctgagaacaatttatccatgttgggaaatgcttactagagatataagtactattgtttgttttcctgatcttataaagtaattcagcagaattgctttctaggggattctttcctttgtttccactctagtggaaagaaggcaccagagagtgaaatcctgttgtctgattgatgagattctgttccggctgtgacagtgcataactcctctcattgccctatctgttgacccccagagaggctaaaagtagcacaaccttgggatataagaaggtttttgtttggttttgtttttttactagcactgtttacaaaaataggaaccatcagcagccttagggtgaaaagtgaaatgtatcttttacccagaaagttaaggaaaaaattggtggggtcagattgcttaatggggctaataaagcaaatgccactagatttggctcctatataagacacatacaaatattttgttttcccaaaccaaaaactgagtccgtaactatagactataatcaacttttaaatcttactcactgattgcaagcagaaccaggggagactttgattactcacagcttaatgttatttgtcttcctatactggaaaacaactgcaatttcatttttcactgatggaattgatggcttattttttaaacttctgttttgaagcatagaacatatgtagtgctgattatgggtcaccaagttaaaaatgtaacattaggtattgaaggacttaaaaataagtaaaatgaagattaaagatggtatgtcattttaaatcagtaagtttttcttatcttttataagaagactaattctacaacaagtccataaatacagttttaaatgatatccttacaaaaaggaaccaaaccgaggagattttgttggttgaatttctccatatattacattatgtgaattaagacagagttaggaatcagaagttttcttttttggaggaaaagaaataagtctaattttttttaaagttatgttttttctttatctgttacttaggtatttcctaattttttccttataaaatcataaaggtgttatttgagctatttggccaattcattaaagataaatagtttatatgtttaatttcaaaatgagaattacatttattcgctttttcactatttactgaattatatcaggtaatttgagagtcaacaaaagtattatttaacagatttcgtagccgtagactaattaaccctaaaaagaaagtttaatggaaaacaaatgaacaaaagagccaagaaatattatttgaaaactgatcattttccactaatattaattcgtattttattttattttatgttttttgagacagtctcactctgtcgcccacgctagaatgcagtggcacgatctttggtcactgcaacctctgtctcctgggttcaagctatcctcctacctcagtctctcaagtagctgggactacaggtgtgtgccatcacgctggctaattttgatattttttgtagatatagtgtttcaccatgttgcccaggctggtctcacattcttggcctcatgtgatctgcataacttggactccaactgctgagataacaggtgtgaaccaccattcctggcccttaattcatattttaaaagaaaaatttcaaaaatctcaagtaagagctttttttgtttccagagaatatattaggaaaatttgaattattatttttactctcattattttagtatagtttgtccatttcagaacaaataaattatataaaaaccaccagacaattctgttcattttgaatgataccacatgtctgagaccaggccagaactggaacacaccacacaagaagggtaagattgaagcttatcctatagcttttgataaagtgtatttattcagcctatactttatattaaaacacaacatccattagaattatgttgttctataaatgttatattaaaaagcaatgtaatttgctagttaattgtttcaggatttgtgattgaaatcacaaatttcagaatttgtggagtcgtctttctctgtgagtcactaattttacaagacagcaatctgaggtgctttagaaaaaaatcatacccaagaacatgtaagtagtcatggctacctgaggagaagggaagccagactggttttcatagaaacaactaaatttccctttgtccccagccaatttcccccctgattctcaatctaaggggattagtagaaaaccaactagattataaatgagtaaatgaatttagattttgcctaggctttcatttttcagaaagatttctttgacttccaacttggggaaatttacctctcatatatgcctactgctggaagatagcaggcatcatgtattatttctttgtctctcttcatttattacaataaagtaaatgaggggagaagctatatcttagtcatcgtttactcatttctgtcctatttattcatcaataaatatttgcagagtgcctactatgtgttaggcattaaagtgagctgtggtaaagagaggaaagggtgggaggacagataccagatatcagtaaaagaaagatattaggagaactttgtgattgattagatgtgggtggctgagagtagtagcgaaacccagggtgactcccaagtgcccaattttgttgcttgtatagatggtcaaattagtgacctaaagaaaatgtacggagaagcttatggaagatagggtaagaaaaataagaaaacaattagttctgtttgtgcctgtaaaatgtctgtgaaacatccaggtgaaaaagatttgtgagcaattgcaaatgtggggctagatcataggagtgttgccaaagctggatatgcagtccttaaaagatccctctaaaaaaggatgtggttggtataatctaaacaactgcagtcagagaaagagaaggatcatgcaggagatcaagataccatggagatcaaacaaggaatgtgtgttatagaacacatgtaaacagaagttgcattggggtgaaaagggatgagatgaactacacctaataatgaacaatttttatcagatttatagtttgctacgtatagaataccagagcttaacgtgcctgggattatacaaaacccaattaagtgacaagtactttttaacaacttacctgttcttagacaagtcttttattgtctccttctcatgttttttctttatttgtaaaaatgaagatatttgataaaatgatcagaaagctgtcgcctaacattaatatattacatacagtattagaggtataaaggaaagcgttcttggtcagaagcaatttcctaacaaaagtagacaaatatagccattgtatgtcaaatacatattatatataagaaaatcagccatgtaaggaaatactgaaatagtacaactaggaaagttacaaagtaactactaccatttttgctctactggatgaattacttttgttacatatactttttatatataattttagttatatatatatatttatttatataaactgggaaatcaaatcaagaatatctrtgatccggatatctgtgatattccctttcaccagctacatctaaatggcatgctgccatacccaggattttaaagaaaaaaatgtttaaatctcaataatttaatttcagatgactgaaaggtcagtgaatcaaattattactagtcaatattaatacatatggtcatgggaggaaatagtctattgattgatttctacacacctaattgaaaaatatttaccaaaactcaagctttctgagccaaagtcaatgtggatgacttttggaatgtccttggtaccatgaagatctaaggatattaatacatagtaatacgagggtcaggccaatcaaaggagacgacagaagaggaatcattaacatccaaaggcatttttacactgtgataattatccccatttgctcaggttaatatgctttcaatggaaacatgtggaataaacagctgtcatggacatgtgccaccaraakaaaagctcttctcagccagaaaaacaaytgggaagttagtgaaccagtacatgctcataccttaggaaagcaaatacttttcactgagcccatagacaaaattaaagtctggaagaattctttttttttggtgggggataggaaataatacaaatcttgaaaacattctaaaatattcagataggttccataaatatttgttcaaaaattaaaatagaataaccttttattcattgttcaatttttatctatcaaatctcgaattatgaaaacaaactacactatgctttacataagggaatagaaataaaagtaggcatagtctggtaataccaaatcttgcatccttaatgcatcatgaaaagatgcttgtggatgttttgtccaaatggctggcatcaacacccacatacaaactgctcctgctcaaaaaaatgcccttgtttttctctgagtacagcattgatatacatttggaagaaatcttattatagtcctgaaagaaagctagtagataatctagtttatttttgagattccagacagaactacattgtgtgtgtgtgtgtgtgtgcgcgcacatccacatgtgtgtgacagagagaaagagtccactgcataaccaaaaaatatgaatttggttcctagaatgcaaaaaaatatatctaaccagtacattttaacccagaaatgttcaatttaagcattaggtctataataataagtggaaacgtttgatcaactatcatttattcatttatttaataaatatacacatagtaaatatttattactattatcatctgtgttattgtatgaaaatcattatgttaatgaaattatatatttacatacttcggttttagattaagcaatatgatattgcctgtaagtgatcatttttacctcaaaaatgactgtttcatatttttctgcctagtatttgatttaatcactgaataatgatatatgttaattcaacagcttgtaaggtcaatttagtaaaagcacaaatttatatgaatgaaaataatggcctgcaaagttaagatttgactctgctgtagaaatggacacaaattacatcaatttaccaaaaagaatagttcttacaatcagagttaagcaagtacttgctcctcttggtggtttaccaactgccaaaataacagcaagatcagatttcttcatagaaagttattggtatgaaactttttggattaaacagttgtttctgtaactattaactaaatcattaaaagggttagcctatttatagtaaccttgaacctttttaaatttaatgttttcagatgaaagcattgatccttccatgcttcataaaatggcatcccactgggcagtgtcattagtgatagtcctactgggagagacaccagtccaaattattgaatgaagagcctaatatagtgaaagatacttctaaagtgcagcttgatgttttaaaaatgctttcatacataatggatgcctactgtactcagctatttgaggtgttgtagcacttactgaattttcacataaattgctgctctctgaataagactattgtaccagtttataaggcttgatatattttctaccttccaaatgggcattcaacgaacttaaattttatctttatattgtacttaactgtaactcagtaatttttcttaaaggaggagaacaaattgtacaatacagtccatattagaaggaattagcttttgtttttaaaaagaagagaatgtgttttatatcatttgacattttcaacttataaattttagcaagcatgcatccattataattacactggttttttactatgtaatttaccacagaacagaatacatatacagacagttaaattaattcaytagataggggacatataggaaagtcagcttcttatagttaaccaatccaaatatattcataaaaatatagatggaaaacttgattcaagaaatagtttccatttatctttcaacagtagttttcaaattggttagcataaggtccaactttaaatggatgaattatgttttgaaaataaatacttgcatttaaatgattattttcagcagtgaattattcttcggctatctctctgcacagagcataagacatttatttatttatttatttatttatttatttatttatttatttatttagacgctttgctaggctaagattcaaaatgggttactagtgaaggaagaggagttttgcctagtttggcaagagatttatctacaagctctataaaaagacaagtttttatttggtgaaaccagttaagatgcaagagttggaaatttttgagttggagtaactattttttaaaaaaactaaccatgaaaaaaattctggggtctgttgtcattttggataacaaggatccgtcccattctattctcccatctacatccatctcccagatccttatagagagttatgcccaagggagattccaggtaaattaataattttattaccaattatagtctactcttaaatctttctgtgattcctgcccttggctagctgcacagaacttccatctaatagatggagtgtacatctaacataaggccaagactaaaatcaaatttgtggagccaactccatgtttccttctccctagcttatgtcacaggtttataagaagaaaatgaagtgtttctgcccccaggttctatcagctacactggaggaatagagaaaaaaaatgaaaatggacaagtaatctaagagttgtaggagatgtcaaaataggaggactagaaacagaagagttatcaagttctttttctttcaccagaaattatattctcctagcaattatgactttgtcatggctaacattagtacctcttaagagtaagtatagggtcagagagggtagaaggtaaaactgagttttttgttctaaccccagaagtgagactacaaagactttcagcgagaaaacaaaaccagctcaggagagctaattatttactagagaaaggctaggttgctggtttaagaagagttcccagattgagccaacaatgaccaaggggcttgcatgagagttcctagattgagctactgttacagtttggatttttcagtcctccaaatctcattttgaaatatgatctccaatgtcggaagtgggacccaatgggaggtgtttgggtcatgggggtagatttttcatcaatagattaataccctctctggggattgggggctgtgagtgactttttacttttgttaggtcctgggagaactgcttgtttaaaagagcctggcacttttcccaacccttgttttcctgtctcaccatgtgatctctgcacacactggctccccttccctttctgctgtgaatggaagcagcttgaggccctcaccagatgcagatgctgggtccatgtttcttatacagcctgcagaactgtgagccaaataaacctcttttctttataaattacccagcctaacaaacagactaagacagccatcagtggtcaaagagcttgaacaggatgccaccagcctgaatataaaggccaatccaggcagaaatggagaccaggagagctccattaaaaactaataaagctttaatttagatacaggtacagtagcaaaggtggaactgtgaggtacaaataaatgggaacattactacaaatttggataaagacattttagaggaatctaaagaagaataaatctattaaacagcttttacactaatgtgtgggaaaagagtgaattcatgaatttcaacagaaaacaaagtaaaagagagacaggaaggaaggtaggaaggaaggaagaaaggatggaaggaaggggaagggaaggggaagggaaggggaaggaaaggaaagaagggaaggaaagaagggaagggagggagaaggagggaggggaggaaggagggaaggaaggagggaatgaatgaatatgtagacctgtgattaagatagagtacaggatgttaatgcttgattgatgtggtaaacgggtcgattcaccttgttggactcccgtattctcttctgcaaaatgcaagattagattgaacctggatgatttataatgttccttaaggatttaggaacttatgattcatgatactaaaccaagttgaataatggatccatttatctgttacaaacttgtttaaagcatgagagtttatcacaaagataaaattttggttaagagtatgttatacaacaaaggcgtccatgaaggtggactgaagagtattaaagggaaaagttgagatccaagaacataaaaccctgatttcacagatggtagtaatggaagttcatccctgaagagttttctgttggagagtgttctgctcaaaatcaatgcatctcaaatttaatgtggatacaaatcatgtgcaaatattatcaaaattcggattcagtaggtcttagagggtgcggtgccragatttttatttctaacaagctccaattttatatcaataagtaccactttgctttcatatccaagtatatattatattccaatggcttacagtgaaaaaagcaaatttatgtataccataattgttcagtcaaaagtcagacttttggccatgttgacaatgatagttatccagaactagttttgtatgagctgattcattctcttaaatacaggacaatagttatgatcacatatcatcaaaaataggatagattatattcaacatattatcaagtttgatggataaatcagtggagcattcaatgccttttagaaaaattgtcatctaaaatgtcaaagcatgttttgttaatataattatataattaaatgggtatattttaggtattttgaaatctttttcatccaggacattatatcatccagggaaaaatacatagcagaggtaccagtgtaaatacacatttttatgctgcctttaggcataattcaatatattttattgtactaaatggaagctacattctctgaacactrtcctgacatagagaaaaaaaatatattcctgttaaaaatataaaattgatctggatattctttgttacatattacttgaacctgttcatctctatcaccatttactgattttcacctgtgttatttttcacattccagtcatgccactaacactttagaaagtagaattagtgctgctgctgttagttcctaccattcagatctgattccaatgtacattttaagatattttgtttacctagcaaagtaactaagaagtttggagaagtgaggctaaaaaaatgtattatgtcttaggctgcaagtggcctctcttgcagaagtttttctttgttgagagtttctaggttgcaagtgtcttccttattgaggcattgcagacaagtttttattatctcacattttctaaataccaactgtttgaagtgtcttccattcctaccctttcacaagcattcagttgatgccttgtactagaagagtgacgtcaagtgactgtgctgaataaaatagctttaaccgttaaggaaagaaactggtgtataaataaagatatctgttcagatttcctttgtaccgccgaatcctcttagcctgtagtacttttgaaaatagaagtaaaagtattgttctttctttcttaagtacacacttgtgttctatgagtctttattttttgtatattttctgttcacatttgaagcactgtgtatgtatgtgtgtgtgtctgtgcatgtgtgttgtttgtgtgctgtttgggaggcatagttgggaagaaagcatgttatagattaggatttaggatatggtttctgaacattctcttgccccatgcaagtacaaactccagcaaggtagtcaaatcttaaagctccaaaattatctcctttgactccatgtctcacatctaggtcatgctgatccaaaaggtaggttcccataaccttgggcaacccttcccctgtggctttgcagggtatggccccctcctaactgctttcatgggctggcattgagcagcttttctcggcacacagtgcaagctgtggatggatctacaattctgagggctgcaagatggtggccctcttctcacagtgccccaatgggaactctgtgtggagttccaactccacatttcccttctgcactgccctcgcagaggttctccatgaaggccccacccttgcagtgaacttctgcctggacatccaggcatttccatatatcctctgaaatctaggcagaggttcccaaacctcacgtcttgacttctgtgcacctgcaggctgaacaccacatgtaagcttccaaggcttgcaccttgcaccctctaaagccacagcctgagctgtaccttggctcccttcagccatggctggagtggatgagattcaggacaccaagtccaaaggctgcacaaaacagcaagaccctgggaccaacccatgaaaccattttttcctcctaggtctctgggcctatgatgagattggctgacgcgaaggtctctgacatgccatggagacatttttcccattgtcttggcaattaacatttggctcttcattacttaggcaaatttctacagctggcatgaatttctcctcagaaaatgggttttccttttctatcgcatcatcaggctgcaaatttttcaaacttttatgctttgcttctgttttaaacataagttccatttccaaatcatatctttgtgaatacataaaacaatgcttttcacaacacccaagtcacctcttgaacactttgctggttagaaatttctcctgccagataacctaaatcatctctctcaagttcaaatttccacagatctctagggcaggggcaaaatgccaccagtctctttgctaaagcataacaagagtcaccttagctccagttcccaacaagttcctcatctctatttgagaccactaggcctggacttcattgtccatatcactatcatcattttggtcaaagctattcaacaagtctctagtaagttccaaactttcccacatcttcctgtcttcttctgaaccccccaaatggttccagcttctgcctgttatccagttccaaagtcactttcacatgtttcggcatctttacagcagcgccccactacccggtaccaattttctgtattagtccattttcactcttctatgaagacatacccaagactggataatttataaaggaaagaggtttaatggactcacagttcagtatggctggggaggcctcagggaacttacaatcatggcagaaggggaagcaaacatgtccttcttcacatggtggcagcgagaagaataagagctgagaaaagggggaagctccttataaaagcatcggacctcatgagaactcactcactatcacaagaacagcagtatggaggtaaccgcccccatgattcaattacttcccaccgggtccctcccataacacatggagattatggtaactacaattcaagatgagaactggttggggatacagtgaaaccatatcacatctaaaccagaaatatcacctatgtaaatttcaaatagctaaattaatttctgaacagatttttggtcagatactaccaattcctttgttaatgaagaaacctcttcccatggggtgccaaagtaaaaagacagaatgcataattgccaaaaaatgtaatgattaggagtgatttctctgactatttaaattttatttgcaagatatcattagtctgtgcttatttccatctagcagggtatatggatagactataacccaacatatgtcaaataattttggtgggtagctcatttgaactaatatggaaactcctcraagacaaaaatgtaataatacattagcaatgtaatgctatcataaattagaaatgaaaaatgttgttctatttttggggtattaatttttcctactgaacatgtacattcattcagaactgtagaaacaaaaaaggggaaagaaaagaaaaagaaacatagaaatatgacatttgtcctctaaatttcactttttcaaaacttaattccaacttgactttaatatagtttagccattataagcattctacctaatgaatttttaagagcatttatatgtaaagtagaaaaattattgttttgatttttttcattttctcagttctgcaaattaagtactttagatattttttaggtttgatacaaattaaatttcaacttatatgtaaatattaggtgtacattttatagttctgttctcagcactgtagtatgaggaaagcactgtgttgtatcagaagctatgaattatacaaaatcagaattaactgcttggatagccttttgcaaatcatttcacataatttggtctctcagttctcatcaaagaaattttcagaggctcggtccctaaataataactaagttataagaatctataggggtatgaccatgcttatgtcaataaaatagtaatgatggtgataataataataatcacatttattaagcacattctgatgtgccaggctctggtaagcagaataatgatctccccaaagatgtccagattctgttccccagaacctgaaatatgttaatttacatggcaaaatgactttatgatgtgattaaggttaagggcattgagatgaggagattatcatggattatccagtcgggctcaacctaattacatgaggccttaaaacagagccacttcctggccgcagtgaggaagacgtagatacagtgtggctggttttgaaaaaaaaaggcagaaagcaggacaaggaacacatgcagcttctggaaaatggaaaaggtaagaaattggattctcccatagagcctccagaaagtaacaatctgctgacaccttgattttagcccagtgagccctatgtcagacttctgatctccaggaactatatgacaataaatttgtattgtgtaaaccactgtgtttgtggtaatttgttacaacagcaatgaaaatttctgatgtaccaggctctctgctaagtactttatattagcttatttttggcctcacaacaactctaagaaataagggccattattatccccattattattaaggtttaggatattttaagtagcttttcaagctcatcacttgtaaatagtaaagccagcatacgaccccaggactgctttggttggataaagatgatgtccttaaaattattagaaaacgtatatctcaaaacaatttaagagtttcttgttttcatttcctctaccgtagaatgaaactaatttttctttactaactgcatgctgaaaagaagggtcaatgaggaaatctctgtgagacatatgggcccaatgggggggaaaaagctattatatactttgtgtaaaattagtcctccttttctttctaaagtcatcaattttctatttttctttaatccaatatgttcagtataaagtcatcagttttcaaccttcttttaatcagaggtatttcctggtattttataagggaaaaataaaatgtgacatcactaacctgttatattgtagaatataacaatgaatcttttgttttataaagggcctgccttccttctttccttccttccttccttccttccttcttcttttccctttcttcctttcttctcttttttcggcctaagcaggaactcattcacctaagaaggaaaacaaagttgctccctcttaagaaagacatcctgctgattttgtcagacaacaattctttcttgctttctttccttctttctctctcattttgtttctctctttccctccttccctccctcccttctttccttccttccttccttcttttttttctagggaatgggtcttgttctgttgcccaggctggaatgtaacgtcacgatcatagcctacgacagctttgaactcctgggctcaagtgatccccccacctcagcgtcctgactaactgggaacacaggcacccaccaccacacctggctaatcttttcgtttttttgtagagatggaatcttgccatgttgcctaggctggtcttgaattcctggcctcaagtgatctttctgcctcagctttccaaagtgctgggattataggcatgaaccactgcacctggaccactgttttctctttactcttatgatgcccccatttatcttaatcttattcttatcgcaactcccagacacctcctgtcctcttggtgcactaaagcctaactttctctttgctcatacagactgagagagatctttttgcccggaagctttgaacattttataaactccttaccaaaataacaccacttaatctgtgtcatctgtggtgacgagcttgtgaaagctatgtggactctttggcactgcatatgataccacattccacatcagaaatctggagcatccagaaagtaatttagctccttgttttcctctttggtgctgaaagcccttgaaaccacttgggggctgctgatatctcagattctctataagtaggaaactttttgataaaaactgcagtaccagcaggaccttttagtgtgatgagcactagaagaatgaacagggtgaaatttgttttgttccacaaagggacaaaaaaaaacaaaacaaaacatgaagatgggtatagacagaaagagaatctgtgaaagatagagccctggttcaaaaaaatgacatatttaaactcaggcaatgaaatagtgagacaacaagttttaaaatagataacagcaacataaataagaacttatttttatatgaagaacctgaggttgtacttaaagtatgcaaagcacggtggaataatacattttacacagcacgcactcagaatccgtttatgtctaaaattagcaaacaagatcaaagtgccatttactacctatggctgcaaattaatgattaaagaagaacaggttgatggttctacctaaaaagtaaaagaaaagttaagggaattaaaaatcacagtattgtagaataggtctcagttaaataatgcacatggatgttttccaaaagaaaactaaactagttctgctttccctctcttgttttttcttaactttcaacaattggctgttctcaaagcccgaatagttccattcactataagtttcaagtgcttagcaaaaatgctgatagcttcagtttagctgttttcggaagtatgtggatttttaaaatactcacttttttctgctatcagaaaacttaagggacgtatgagaaaataaatatgagccgaaaaggcctttttcatatgtgaaacattgcagagcataacaatacgcaagttccccaatacattgtagtttcctataattaaatacttatattcacatagaggaatatatcttacattttcaaattaggcgaataattttatagccaaatcttttagtttatatagaacccaaatgcttaatatatctttgttatataataatattttatattgtggtcttaaagccattcagaagagtcatttccccagaaaagtcaactctgttacaagaagttacagagagctttgcttcttattttgtagtgtgcaaagaaaaagagaaaaatgggataaggatggagggaaagaggaaggaaagttaatactttgaatgctaacactaaacaggctgttacaaaagcgttctgtcctcctcagtcactgaagaggaaatgcctattttgtatctccctcattgtcttcgcttttgctggacttgtcgtaccagtcaccccagaagtcactcagcatgccccctctcattcactggttctctgcaaggtcttttgacattcttggtgttaggcacattaacagaacagagtgactgaggtagataagattatcttaaagtaaattgtgaggtgattttttattaatagaagagttccatcctgaagaaattacttctcattctgcttggtgcattggtgcagttagatattctgatagtccaattgaggkgtgtgtgtgtgtgtgtgtgtgtgtgtgcatgcgtgtgtgtgtgtgtggtggaacgtacagaaaagagacgaaaaagagcaatgaagaagtgtaataaaattagtcctcaaatatgkaaagaattaaatggacgtttccatctcttctttcaccctattacctcattctaactattcttagcaggtaaagaaaaaacgtctttactctatttttgaatctaatcaatgcagaatagaaagtttatggtacccttaaggaaaagaattcatataaagtgtattctcacctaaacccccaaaaccgtaagaatgttttcttcttagtttctttaaaaagctatgaatcattttactaggaaaataggatttttaaaaggtcacagaatatactgaagacaagaaataatttttctttaaatactatataggatgaggaaatagagaagaaagagaagacttccccagccatttatgatgataaggaactttaagttcttttgccttcatatttgtataaatttcctaattggccaacactacaattcacaataacatgaattatataatgcatgtaatttcttcagagaaaatgccttactggatgtgtattgtgcactagttagccttgcttattattttttttaagtgaaacagcatgggttgttagcaaatcaaatttctttaaaaataaatgagcttggatagtctcctgatgtctacattcctcatggcataataaatgcccatcatggtttcgtggtgacattcatagtttcaaatattttgtcctgctgtcatggtaagtgcattcatacgtggaagattatatcccaagtttgcatttagaagatatagtcactgaacccatatgttgcccatcaaaactttttggctcttactgtttgaaaggggaaattgggggcctgggtgaggtcgctcacgcctgtaatcctagcactttgggaggccgaggcgggcggatcacgaggtcgggagatcgagaccatcctggctaacacggtgaaaccatgtctctactaaaaatacaaaaaattagccgggcgtggtggcaggcacctgtagtcccagctactcgggaggctgaggcaggataatggtgtgaacctgggaggcggagcttgcagtgagccaagatcacaccactgcactcaagcctgggcgacagagcgagactctgcctcaaaaaaaaaaaaaaargggggaaattggactatcctttgtgaagcacccaccatgttccaggttactgatatcgtacattcattatcgacttaatgctgaaagataagtgtgattgtccctgctttacagtttgtgaagtagggaggtgtagtggttaaatatattcaaagtcatatggctaggaagtctggtgtcagggttcaaaaccaggacgtttgagtttcaaattgctgggttttttcctccactctttatagtattctgcttctgtattctgtagtttctggtcacacaaaacacaatgtaaaatgtcagcataagtgggaagttttctaaaaagtaaatgtgtgaataatgtgctaagaaattcaggacccaggtctcaacactacatagagaagaataatgacatttgtcttgagtttggtatccttgacaccaccatgttttgtctgttagcctgccaaatgtgtgtgtgtgtgtgtgtgtgtgttttaatcatctttctctttattagtataatataattttacctgccttgatatcatgtaggcataaggtattagtcttgttccatttgtaaagattccaggagtgttctgctttttataacacttcaaagttttgtgcttggagctccactatccaagagaggcaaatggctgttaaggaatctagtaaaacattccaatataaaaaccttcaggggcacatggtgatccattaataaaacagaaattcaaatgaaaactttagtttaacaattaagatgatccygactccttgctaaattcccattgtcttatgggatacaagaatgcaatatgagatattgtacaatgcctttagtattttttctaatagatttagttccatcacgaactgctaaaacagtgtgagaaaattcttgaagaagttatataaatattaatgtatttcagagttttgcttattgtattgatatatgttcaaaatgatgtattttttcagcaatacaaaggatataacttatctcacctttctttaggcaaatgaatgacaacaaattacaatagtacaatatcactagatatcttctaagttcagtgattaaaatgtacctactaaagagaaataatactttaatcactgtaaaaacccaagcaaagtagaatttttcaaagccctgtggagtggcaaccctatatctttaatatctaagaactagaaaataattttaaatatacatatgttttatattccttaagagcaagtgactttaggtgagaggagaccaaaacttaagtgaattaccatttaaagcaaaagatcaaactagaatgttaaattgtagcaaaaaaggaagaaattatgtgactctttcatactataatattaccagtttggaaaataggcctrgtaataaagtttgttttactaattctttctaaattccaggccaaaaatatcatgtaactttaacatggctttcatttccagtcatgtacagaagagtcctttaatcttatcttgctaaagaaaagaaatattttttgccttaaaactgtattctataaatcagttcatgtctgtctttctacatacaaattaatttctgtttgttgattaaaatctgctggggcrgagaggtagctgtttgatgtaattggtctatcaagtttaaatgcaaatgattaagtagggtaaacattagcagggatggcaaacagaaccaaaagcattttctcatggtactctgctggaaagctgatgtgatttctagacagaacagacagcttacccaaaactatctaagtacaaatatggctacctctttcttctacattctctctcacctgttccaattagctgtaggaatcctcagggagaactgcatttcacaattagattttagaattgccgtacccttaataaatacgggagcctttaatgtaatatctgctatcttttcttatttcaatttacctcacctaacaaccactttgttttcagagcctctttgtagaaggtcagtgtgcagtagattggctttgttcacagactacacaggatcctcactggaggttttgtttagagctcatatcagttaatgtctcccaaattatttcttaagtgttacacttgatttaccaccacagtttccacattatttcacaatacaaaaactcacaaaaaattaccatactttcttcatattaatacacaaagaatgatgaacttttcctgtaagcctgcctgccttcttcttccttcctcttttctcatctccttcctagcttctttcactcaccatctcttcttttttcccttttctttctttttttcttaggattctgtatttttacgatgcaagctctgtttgtggtgggtgtttagatgacattaaaagatctctcttttaaaatatttcctttccaacttcagcaactatggagaaaatgctgatacaatatttaaaatttaatatacgaaagttaattttctattacatactccattgcatgttatagtaatgcacttgaaatatattatctccatttcatatcaccatgccaaacttacaaaaattcagtatctttaaaataccaagactatttagaacaaatacatgatgtggtgttcataaaaacaatattggatkaagagtcacaagagtcatttccttaactcggttctatcttcaacactttaaattctctggtccttagcttctttagttacaggatgagtgactgcaataaattatctctaaggtcacttatcatttcaaatgtacatcttggaatcactaaacatttccttataaaagggcaataacagaaatatttcctacagctggagtcttcttatctgccaacctcaaccattcagagcccagctctgcaggaaacacccaggttttgagcagtcaaaataaatgctgatgtccatgaaccaaactttattcacaaggaaactccttgggcccctctcacagagactgtttactctttacattgaatctcttttaaagtttgattatgttgttttcaaaggcctggcatgttagtggcaaactggaaagggactatgagacaatcacagaagggagcaataaatgggcgagtgcttcgaaggctctgaggtgctgcacaaatgcgggctgttatcattagcgagagtgactgacaactgacaggaatagtgagagaaaagataaatcattgtaaacaaagcacaggaatttcaaaatactgtttggggtggggctgtttagtatattggcaagtcggttgaaacagttcagtaattcctgaaagtctcactgaattatagcatagtatgtgcttatagaaataacagttatcaaggagatgtttatttacattctgaataatatttggtttaacagatagtgtaactggaaagtgaaatcttaagcactatataatggtattttgacatgtaattttatttgacatcagaagagtatgcaagatgctccagatgttccaaatattctccatctaaaataatttaaaaataaaaatctataaggtataagaatctagatttcaaatacctagaaaataatatctgagtgatcttgaatacataaaatattactttaattttgaaatgtagtttatttttcttatccataatggtagtaattaagatgaataatattaattcattttgttccctatttaaatgaaacagtactatgcctgaatcagaatttcctgcatgcagcatggcttctaagctcacaagcttattatgagagtagtattggaaagatataaagcatagtgcctgccaatacttaaaacatattacatgctgaggcaatgcaataaaaatgtttaataattcttaagtgatagtggcaaccaatctaaagcaaactcaagttacagttgaaaacacttatcaattgatatagagttagaaaccaaaatcaaagtttgttcaatgtcaagttactaaaatattcattgaaaactccaacagcaaattaaattataagatgaaaataagaaatctgacatactatctttttgccagtccaggcataaaagtaatagggctagaaattccaactgaaaattaactgtatgctttttctcatattggagaatctgaatcctagaatatttaagccttgtcttatatcatattatgcataaataaactgaagcccaagaaagcaaggtcacaatgaggttaagatgaaacaagaaacttgttttctctagtctctttacactagtgttctttcaagtatgagttataaaacagatattttatgtagaattttttttaaaaaattcttatcatctactacctaacattagtggcagacagcattgtaagaatgaagacctgggtggttatcagagtccatgttcttcagggcttgaggccatgcttttggaaatcatttcccagagccggggcatttgaggagagtacagaaaagcaaatgaatggtgaataggagaaaggccatcagccaggcagctgcaggttagacggatggattgacttcccagcagagcarggcacagtttgctcaattacccttttgtacagctgggaaagaaagacaggaacatcagagactgctatctctcagttaccaataacttttgaaagaggtatttgaaagacatataaatgatattttccactgcctccctgtgcagggaaagcattgtatgtcaagtcaaaactgaaattcactagtaaccaaaattaacagccatagtctttggcaactatctttggtcacactatcacctagaattggctttgtactttgtatcagagctttacatgaggtccttgatctactcatcagtgttttcagaaagacttctggattcccaaataaattcagaaacttctcttaaaaagaaaaattagtactgattaaaaagcacagtattacagaacttgttattaacattttatttttgcatttactttttccaatctcaaattggtaagcacaaagcttaagaaaacaaacaacagtatttctttaggagagtttaagttccagctttgggtttttctctttctgtagtttatagtgtgtggcaaaaagggctcgcgtgtgttaaagccaaaatgcattttgcattaacaatttgcgtttagaaatccaagcacctaacaccaccagagttaatatttgctttggactcttctacttatttagtctcaagcttttccaaagagctaacacaaaaagacagctttcctatttgcctagtgagtgtgtgatttcacacatagtgtatgatatgcttctacagagacttggtattagctgtttttcatgtgagctgtgtacttagttatgttgggaaatgtgaactttgtagttgaaaaatgcagcaaactgactgaggctcatatcgattctactttagaaatgtctcctgtctccttttcactgtgcctctttttcattcccactgccctatttcactatgagtacataacctaaacactttaacacgattaccttccccgagtcccttctccagctagtttgccttcatactgctgccataattttcaatagcaaaaatctgaccacttcactgccatccttaaaatgaaccaaaaatccttttgttgactccacattctttacagaataaagtccaaatwgtttaagctattatttaaggctttcaaagtatcaccccattgcttctttcccaggtgcctttccttccatcacctcctacagcccctaaacctcagccayactggctgaacatgattatacccttgctccagcctttctcttgcaaggagtttccttcatccttctttccacttgaagaaattcttatctgtgatgattcagtataaatgtccattccaggcaaagccttctccagcctattcatcaatccctcctctgctcctgcaacatttggcatataatctccattattccaataaataaaagccaaagagacataataactttcagcactcgttgtatgaaaagcacttttttaaagcaacttatacttattaatttagtatattcatgataacactatgagcatgatactattaaaagggggaaagttcccttgtccccctcacagggcatgcgacagggagagtggctcgcttcttcagtgccccactgctcaaacctctagggagcacacagacgggcaggttatggggcaggttatggagctccgaccctatcgcagtgtcttgtgctcttttagtttcgccgtctataggcggcttgtgttaaccagcttaattagaccttctacgttgtcacaaggacagagggctttctgtatctcgggttcttgccttggtgtaccggaagaatcagatcacgtatgggcttggagaatgagtgcaagcttttatttagtggaggtagctctcagcagatgggggaagccagaaggaggatgaagtgggaaggttttctcctggagtctggccactcagcggcctagcctctccttcagctgcccccgccaactccgcgtctgtttctgcaagcccacggcctgccggcctgctggtgcctgtcaatacatacctcttgacgtccagctgctcgtttgttccccccaccttccccccgccgatgtgctgctcctccagacgaccacctgtgtgtctctgcctgctagggtctcagggtttttgtaggcccaggatgggggcatggcaggccagggtggtcttgggaaatgcaacatttgggcaggaaaacaaaaatgcctgtcttcacctaggtgtggggacacaggcctgggggtggagccctagccagggaccacgtccccctctacccagctcttcccttcccccttctgtatcatttaaagggaccacgctcttccctacccagcacttcccttccatatcactatcattgtcctcaattttacagctgggaaacattagtgcatattggctaagtaactcactagaagtcacctagcttattagtagcagagctggattcatccttaccaggtctgaggccagaaacaatgccttaattgctacactctgctgctaattatgtttcatttctgtcttctagatttttatctccttggaagaggtagcttatttatatgtatatgttgtattagaccgtcctctcattgctataaagaactacccgagactgagtaatttataaagaaaagaggtttaattgactcagttccaccagctgtacagggaacacagctgaggaggcctcaggaaacttgcaatcgtggcggaaggtgaagaggaaccagggacatcttacatggccagagaaggaggaagagagtgatgaggaagctgccacaggcttttaaaccaccagctcttatgagaaggcactatcttgagaacaacaagggggaaatccacgcccataatccagtcacctcctaccaggcccctcttccagcattggggattataattagacatgagatttgtgcaggaacacaaatccaaatcatatcatatgcccagcaggagtatagtatctggacattttagccaatcaatagctttatgtccaatttatctgaattaatacgaatcagagccttttagattaaggaaattttatttttaaaaataaaaatattttcacagaaaaacattcttagaaaaaatattgargactgtttggcacagatcagtaataaataacttattaaattctaatcagatgtttagcatatatcttttacagtctttggattatatcaacaatattagataaagatataacctacactattcttcagatatatttaatttttttcattttcaaaagattttattggctttcccacagaaatcattataaatattctcatagctacaaaggctttagaacaaatagaaaatttccataactttatctttctgaagtataattgtgttgaagtatgatcagcgatttttattgatcttatgtgtttaccttggtgactgttaaataagattttgtattggaaattttctttgttgaacagctccctgtttttaaaattagaaacacaaatttatggatttctacataacaaactctctaaaatgatactctttacctaagaagtatgtaatatatgcctgttaattaaacatgtactaatagttatatttgcatgttgaggcttcctgcaattcacaaaacataaagaaaatgttttaaattgattctaggggtggtgttcttattagctgttgtaaatacacagagaggtagaattgtagctgaagaacacacacttatagcatatttttgtaggactcaggtgggaatgaacttgaaaattaccattggattttcagacagtaatacaaagtatttcagtcttttccatgtggtttgtttgtttggtttccaattaattacttcctgggggaagcattgggagttgtttcagttatagattcataacaraatgagattcataaactaaatacatgatataatctgaagccctgctaggactcttacagctcgtctttataacctagtattcctttaatgagtaggaacagtgaacttttttttaaacccaaatgacactattgtctttaaaagctgttaaaaatagcagagccaaagacgtaatattataatattcagttaggggaattttgagtgtcattatctccctaagcagtaaccatgaacaaattatcaaagccattgtctcttttaaaatggaaagatgaaccaaatgtattagcacctcagtgggattgggaatatgtgaaaaacataatcataaaacagcaattgctaagcctctactcaagacactcttgttcatcagaggttttggtgctgttggaaagtcagcacctgctgaaatctgcctggggattcagctgcctagactggaatcacctctgctaatggatgccaaagctttgcccttgaagatgtttgtgtccttccctctccctataccagtggaatttagatgagactgtctaaatgtagaatatattgcataggctgaagaaattgtgtgtatcacttgtttttaattaatagactatttttatctgttcttagtttatggraaaatttgagtggaaagtaaagagctcctatataggcccgcaattccctgcctccccacccccttgcccctagtttcccctattattaacatctttgcattagtgtggtacatttgttgcaattggtgagccgatgttgatacattattattgactatagtccctagcttacattagattttcctgttgtgttgtacattttatgggtttcgacaaacacttaataatgtttattcattatcatatcagaataatttcactgccctaaaaatgtcctgttctccgtctattcattctttcctccctcccttgagaccctggcaaccactggtctctttactatctccatagttttgccttttccagaatggcatatagttggaatcatacagtatttagccttttcagactggcttcttttacttcgcagtatgcatttcaggtcccttcgtgtttttttcatggcttgctggctcatttctttttattgctaaataatatttcattgtctggattaccacaattttttcattcatctrtygaaggacatcttgtccaagttttagaagttataagtaaagcttgtataaacattcttgttcaggtttttgtgtggacataaacttgcaactcatttgaaaagtcgttaattgtgaaaagtgtttttgacagagaggaaagacacaggtctttaagttagaaagactttaatctcaaccttgccattttagtcattcagtacgtttttattggaggtctactgtgctacccctgccgtttttggtgttagaaatgcatatagggctcctctgcctgtaacctgagtgccccacctacattaaaaagcctcattagacttctggttcctgatctgaaagakgcctatcttcttgaatattcatgattttctattttattttgaaaattagaacagctgccacggacaggacttgtatttcctgggagcaagtgccaaattgctacatagcatcccattgagaaagaagtgataaaatgtgttagttcattttctttctagtccttctaacctatatgttttttaaaatatttgtctaaatatgaaaagcattttaatactttccaaaacaatattcttgaattatccacaatataaaatgaaataaggacatggaatcattttttgtatatctaatagtgatgagaattggacttgagctgagaattcattttgagctctatctccatcacatactggcttcgtgatattggcttattctcttgactttgcagggagaacagtttcctattggtaaaatgaaggataataatatttgttcatcatacaggtttctttgcttatcatacaggacttttgtgaagcccaaatgcaaaaatgtacaatgtatataaaagaatgttgcaaactataaaacaccataaaaacattcagtattattaccaattgctttaatgtatttctaggtctatttaatcttttattgtatatatttaatctatacaacatgaggttttgatatacatatgccttgtgaaatgatgactacagttaagcaaatcaacatatcactctcctcacatagttatcattttttgtgtgtgatgagagtacctgaaatccactctcttagaaaatttctrctatacagtacactattattaaccacagtcatcatgctgtactttacatttctagttgtgtgtcctatacagttgtaactttgtagcctttgaccaacatctccccacttctgacatcttcccacccctggtaatcaccatccactctctgtttctgtgtatttgccttttctagattccacatataagtatgattatgtagcatttgtctttctttggcttatttcaattagcataatgttctccaggttcctctgtgttgtcacaaatggcagggtctcctttgttgaggctgagtaatattttattgtgtttgtatctatatagacaatttatttatcctttcatccataaatagacactttggttgtgtccatatcttggctattgtgaataatgctgcagtgaacaggggagtacaggcatctcagtattgattcctttcttttaggcatatacccagaagtgggattgctggattatctggtagttctattttaactttttgaggaaycttcacaccgtttttcataattgctgtaccaatttacattgccaccaagagcgtacaaggatttccttttctctacatcctcaycaatacttggtatctcttgttttttcaataagaaccatcttaacaggcatgagatgatatgtcattgtgattttgatttaatttccctaatgatgagtgatgttgagtaccttttcatatatctattggctaattatatgtcttctttggaaaaatgcctattcaggtcatgtgcctgttttttttatctgcttctctgtgggttttgttttgtttactactaagttttatgaattccttacatattttggatatcaaccctttatcaggtatatggtttgcaaatattttctccctattcataggctgactttttattttgctggttgtttcctctgctgtgtagaagctttttagtttaatatagtcttacctgygtattttaattttgttgcctgtgcttttggtgtcttatccaaaaaaattattgccaagtccaatgtcaaagagcttttcccctatgcattcttctaaaagctttaaggtttgtcttacatttaagtctttaatcaatgttaaactcattttttgtatattttttatttttaatttaactaaccccttactaaattggggtgggattttttcatcacatcagtactgaaatctttattttctggaatttcatagtctactaatgtcagtgggtcaatacggttatgatctgcctaatttcctccagatgttaggatcctctgaaaagcagatgtcaaaatggatttaacatacaaagaatgtattaggaaaaacacctatgcaagaaaaaatgaggaagaagatgggggtggtcggtgtggagaataagcataccgcagagtaaagatggtcccaagtgaaagggagaggatatgaaggttgggtggaagcgttctagactgtcatgcagtctaaggaaggttcatcagggaatcggggtatccgtgagctataatcagccctcataggagtctcttgtaaccaagaaacttgcctgtcttagtatacttgttgcattcaattattagctgggaacagctggtaaaagtgtaaccttagcacaaatctggtaatagacagaatgtggcagttgggtaagttatgttcccagcagttggagatctatgaggaacattttcatgtccactagacttcacagagacttttttccctaaataataaacaaaagtgatgaaccacttatttaataatgttttactaaggatgtgaagaggagaagcagagacaagtgagacagaatgcaaatattaccaagtgtgggaaaccatctgagagcaggcacattcccagaagaggggttcatgtcagggtttagtaacactgtcctcatgttcgagttcctrtgtaatcagtctacaggtgccattgacctgctgtaagaacttgttttccttatccagtgtttttgtttatgttttaccaccttgtttgtgatagctagtcttccaaaaattcttctgggcggtgcatttaaccatttcctaaattgcagaataaatataagacattaaaaaactacatttggcctctgggatataaaatgaagttttcaaagagttaaaatctttgggagtactggaaaatttcaaaacgggaggcaccttcagatgcagatttcatacccttagaaatgataaaactacctttcaatacagcttcctatatttctcatctctactcattgccttcctaaattatcttgttctttttcccatctttcctcccactcttcaattaagaagaatgactgtcaggaaaaatggaacacatgaaaagttattgttaaaatattaatagatgtcagtatgactctctaagttcatgcattccagagttaccccactgggctaccattgtgggcaagctacaatgagcatgactctccattctcactcagtccttgaggtgacacaccatctcttaaggcagaaagatgattttatcttcagatagcagattatactgatttcccaagtgtatgtgactatttgttttatttttaatttcctctttcctgtgcttttagtctccttcaaaaatttatcttggacaaacattccatctctcctttctcctcaaagctagaaaactagatcttatagtaagctgacttcagttcttaaagaaaggacaaaatgccatagaaagccgtaatattcttcctatgaccttaacttatattgcaacccctccagggagctgtcaattaaaagcatggaatttacacaaatctaagtctcggaaatcagccagcaagctgcaccaaatatgtggaaaaatctattaaatagctttttaacctttactacttaccatgtttgattgtacaaatctatatcctcaggagacataggcaatgctaattgtgattcatgtgaagaaaagagcaaaaaggtatttcaactgatataaacatttttcagtatgaggttagatacttaatgtggaatataccagaagctagcatacyggactagatcactcaaccaattcagaagcagaaatctactactctgctcatttagtagccctaataatccacttttttatccctggtaattcactacctcaattataacacagcattttctaagtctgtaattctaatactattgaatattactttaaaagctaaagcaatacagttcatgtaagctattattaacagatgctttctgtgaaaacaatgatgatcttattggctaaaagtctttgtgatatattttttctaaagcattttgagggatattaaagcattagaaacttttggttttggagtttggtagtgttatcaaagatagctttgattttctcaaatcaagagatctttttgttgtcatgacattaaactatttgcagaaaacaaatttaataatgtcacaataactgtgagttctttctgaagacagacttcattctaaactccaaattttccattacttcagatgattcaattaagatcctttgggaagcattatgcctgcctttctgttgataatgtttttacgaatgcagtacactcttcttcttgctaaaataggtgaattgtattcataatttcaatacaacttatgtggtaaaatgcacaggaaagtgtaatttttctccatttaagtagaactgatactctgaaatagttaaacttagattttcatgctcagaaaatgtacagagcaatagaatctaaatatattcatctgtcctttgcattacttagcctgaattaatataactaatatttcaaatataagtttctacatctccagttaagctagttcccaaatgaagtcaacaggatcagaatctagactaaattgaagaaaatttagttctttagcaagaattaaattgagaaaatgaatcaggggagaggggagcagaaggaaaatcatactttgctagttatttttattgtattgactaattatctgagtgaaggactctacttatatgagcaccttaaggactcagcctcaaatcctaattagaagtataatagtaggaaatagtcaactttcggaacttcagttaacacaaattattaattacatacatgtttttgagcaaaatatatagtataaagaaaaacatacttaaacatttctcctgtttagtcctccttactatgaaaatctactttaaaacaaaatagaggcgattgttctttttacacacaaaatctagatttttttggttcattgtattctttctgcctatcccccccaaagcacccccttcccacgcatacagagcatgaagtatttttaaatgttttttatttaagtttatcaccacttaagggcctgtgccttacttagcatgttggcatagaccccatagcctggccaaaaatactcatcatttaggaatgatgacttggtaacacaggggtttcattgtggacaagtatgtggaatctcagtctcctgctcagaaaaaagaatgtgaggatcattgccaaggaaaccctaaagcccagtgcttttagtgacatttcaaatgtaagtctagatctgtgtacttttttccatctatattatattccattaaaatgtttttaaagcaaaaatagcttttggggggacaattttaagaggggacaattttgggggaacactaatctcaaatcaccacagtgctcccctctcactaccctgtagctgtattccctaaaatttcaaagaatagtatagtagatgccttaaagttcattcctggatctcaagttaagaaatgctaatgagtgcagtagaatctgcatatattctgatttaaaattcatgaggcaactcaaaaaataaaaataaggtttcacaacttcagtcaattctgttgctttttgatcatttctaaataagatttttgcttataatttaaaaatggccccaaaaggaatccaaatgctagtgttgatgctgaaagtaaagagaaaatagagatctaacattttattgcattttattagagaaattttatgtgcgcttatgaatttgggaaaactgccagtcttaggacatgttccttatgaagatcaaagatctactctgtagaaattgttataataaaaattgagtttgcccaaagagagaaaaccaagcgtcactcagtgcttctcatgcactgtgctattgaggtagttcctatcttcccatctatagaaacctcaattcagtgatgaggtcaaatgaaatttcctccaagaagcttttaccaatatcctcaatctcattgctgggattcctttctatacagtcccacagcatttggtttaccaacccaaaacctcacactgatttcatcttgtttcttaaggaaaaggcctctgtattttacttatacattttcttcacaaagcacacctaaaacttgccctgtagcaggtgtccaataaatatttgatgcatgattgaatgattcgatgatttttgagataggccttaaaggaaacataggaatctgaacagagtagatggggccaaggaaccataaaattaggtagagatggggtaaagcctaaactaattgggagaaactgtgacgtatccagccccatagatcatttcatgcttgtagaataacaaacwatcaggctaaggtaaattaagaaggtaattttctgcacagcaatgtaaatatcgatagtgtatttttaaaactttattgtttgtgtaattcttttctatgacataatatggattattatattggcttattgtttaataaaaagataaatatttagagcattaaattatatcaaacttggaagtaaaataaagagtacctatcttaaaacataatcctgggtactactagtagtttataatttagtaacatgggcattttccctctgaagattattccacagtggcaagtggtggggggaggaggaaggaataattactatttatcttatttgtaggcctcactcaattatatctacattataatgtataacacttgagaaaggcaatgcagaaaatgaattttgaataaacatatccctacttcagatgcagcagacccaaattggcctctaactacccccatttgttgaaggaaaattaacaaagaaaaagaaacgagaaaaagcccttctttctatttcacaaaatgacattagatttcatcaggtaacttctctaactcagcatcccttccaaattacttggcagttatagccctttgtatctcacacacacacacatgcacaaatgcacacacagagaacttactttatatacctcatgaccttgatgagaatcttaaactcttgtttatacaataaagtatgggagaagctgagagataagataactccatgtgattgaatcataaaatctcaggtttgaaaaaaatacctttttcactctatcagtagaactatgatattttatcagtctttgtcatttttgtaaaaagattgggaatccacttcctgaagtcaggaattaatccctcattgtgatttaatatgtttctgtgtggcaaacaaatttgataataaccagatactatcatgtatcattctgcttctatcccttagcttgtgttcactgattatttagtcctatgctaagattctatttttccaaaaattcctttattggaaacccagtttaatcacatgtgagaaaccaatggctgaaggtttaaacaagtgattctgatttgcataaggtttggtgggcaattttgcctcccaatgggtatttgtcatgcctggagactttttggctgtcataactgggggaagagtggtgctgtcatctaatgggtagaggcaaggctactgctaaacatcctgtaatatacacagcaaagcactctcacgataaagacttatttggtccaatagtgaccaggttgagaaacaccgctataaactagtgttacaaaatatttgcattttctttagagttgtacatatcctaattcattagtgaaacaaataggagcattagcatgtctgtcaaaattagtaaaaaaatatgaaagtaatttctaaggataaacttctcatttctatctgcctcctcagggacagttcatttgttcaaataagtctctgtaaaatttttgtgaaaccggcatttagttcttataagttctgagtccattgtagttgcagttaacccttttatgacacttagcagagctagagctcaaaacttcttttacggatgatgatgctattaatgtattggttcaataaataataattaaccaggctaaattacagcatgtgaaaatagactgtctaattctcattctattttctgtattatttgatgttcttctgcttgaaatgtggtagcagattctgaattttaatctacctcaattcaaatgtctatatgtcaggaatgcaaagagaatgattcctctgaatttggcagttagttttatggaaaaaagcatttgtcaccaaaatggccaaaattacatttttattatttcaattagaaataaaatgtttacctaacttcaaaacattaccagagtctgttttcagtgcctcttttaaatcattttctatacaaaacatattactgtaactagcttatattttatcgtcacttgcctgagattctatatatcagaattacttctttaagagatttttcttttcctgtgctcaccgcattgaatttccattaatacttctatgtaacctttgtaattctattgttctttacctttggttaataaccttttatttaaaaatgcctaaataattacacactgcttctcaagtatgacacattttatatcgtattgtatgttaagacattttaatagcaacagtaataataagtcataaaatgtcttaaatttataaacacatttaatacagaaggttctagtccaatttaaagtttcttttgacctgtgcttatacacacagccataacacatacagaacacacttatacattcccacattggtttacacttgacatttagcctctttcaggaaggatgtcacaggcattctctatgtccagtagtgcccgataatctctaggctacaaaaccatgaataatttaactaacaaatattacagggagaaaattgcaagggaattctagtaagctaaactcaatttttagacttggcaattcaaagataaaaagctgtttcttctatgaaaaatgtaaacagaatcattcgagttgacaggtactttgggtctcactggcacttcatctcaaagattaagatatcactagaaattaggacgtaatttatcaccaaatcaccatggtctttgtagcgactttatccctagggggcgcgagatgttagctctcccacagatgcaagccttcagtccttctgtcagatgaacttgggagtcagtatactctcacaagaagagagaagttgattattatagcaaacttgaaaattgattctaaaataagcacgattatggcttctaacatgccatccaacttactgccactcattctgccctaggccttatgtctgtaattgttggctttttacctactgccctctgtctagtgtggtatcttatttctttgtgttcgtcctgctcttcaaagttctttcctggctgaggatttggatttggatttggagctgtcattaaaagacaccattcatgaatttccaatacttgaataaacaacttttactttacggtcatcacaagtgaagaaagggacatttcatgatatcatttgcaaattagggagcacaagtaatcaatctttaatttctctttaaagggaagggaaaatgttctctcttgtcattccatctgtgaattcctataaaatgtgtttgctgtttgtttctcctcaagacagagcttgccacccaaaatcaaaatccaagttctctacacatccaagataagatatgaatggctttagagtatgtggcagaaatgagaattctcaaaattccagtgttgtcaactgctctctgattttccaaaatgttagtttgataaccaaaatggaaagaactccagagtcattttagtaggtgcccattagatgctaggcgttgtttctggagatacaaagcttaaaaatacatgatctcttccctgttctgattgtgctttcatcatgccaatacactatgtatttgaaattcatagagctttaagactcattataaaatattatgtatatgtagcacattaaagttctatagagaagagaaaagaaaaatggtctgtgagaaagggcaaagcattaaattcttggaaaaggaattttcttatttccctttacctggcaaaggattcacttcattggtacctaagctctgtaaactgttttcactccttggccaatcatgaaaacactgttagttgccaaaggaaggtatgatttcaaataataggagacaattacaggtgcatgccctgacataaattaaggtatagagatggatcctctcaaaattattacatattcaagtgccttgttataagctgatgaaaaaacaaaatatgaaattacaaaatggtttccttggctttgcagacctctacctgtgaagtgtatgaacaagacttaatacacacagcagaaattccacatttaggagccaaatatcacagagaacaagtaatgtcatgtgcaataaagcaatttcctaaatgttattagtctgcatgtctgcagccacctgtctaaagctcctttatttttattttaacaaagttgaataaaaaaatttcttcatttacagtcttatgcttggtttgatgttaaaagggattataattgcagtatagagaacacaaaacaattttaaaattatagagataaatttttattatgagactgaacatatgataagcaatttgaagtaaacctcatgtctcaagtagtaaatgaaaatgcattctcactttgcatatttggtattctgtcttaacaatgttaaaaatgctgaaaactagttgttatgttgcatatttacatgaagtgtgtgttctttgttatgtttctgttcactggggcaaaattcttaaccttaaatgaaattttggtatacatggtgattgatagataacagtcgaaagatggtatcctcccagtcctgtttcttcagaaagtcagaagatggttttatttatgtgttgcagattgccgtcgctttgcattttagcaccacctggtggacaaaatatcatttgtttttttctctactgtttaaagtagccccttcacactctatacccgattatgatacaccttaatagayattcagctgtgtaagttctaaattttaaagattgttgtaaataaactaaggttaaaaaattgaaatgtttcccaagtactataaccaatttaaatgcctgggtttttttaaccttcataaatatatccagatttgaataatgcttttcattcatatgcaaaaattgcttctttccacattttaattttttattgtttatattttttcttaatatagaattaaataagatgaggcagttttctgtatgtacaaaattgtggtttaaattatattgtcttccaaaaattcacataatcactttgtaaatagcactttatgaagcatgttcatactataaattcttactatgctaatattttatacaaaattaaattagtattttaatttatactactacaaaataagccactttccccttataaataaaattcagttgtggtcttatgtgtattaattctcagtttttaatagttttttgaattttacagaagaaaaatttgataatattttcaaatgaaaaacacaaatatagttaaagctagttttgagaattttaatcatgttagtctttgtgtagtcccacatttctataaaatatggtggaaattatttctatgaaatacagtaaagaagataattcatctgcagattccackatgttcctttggaatacaccacttacctgttctctagtaaaattggagatctgcaaattttgattgtgtgatagtcaaggattcaaacattcagtagctaaatagaaaggtggtaatttttaaatggaaaatatattctagtctcataccttttgtataccatttaaaataaaactatagcagatgacaaccttcatcgacatgcatcttgaagttatttgtcatttcaagaaagcatttaaaattttgttctctctctctttctctcttcttcctttttttttycccccaaaggccttggatggtatactgtaaattcagcatatggagatacmattatcataccttgccgacttgacgtacctcagaatctcatgtttggcaaatggaaatatgtaagtgtgacctacctgggacttggttaattgcccttgttcttttaaataaaattctttctgtgagtaactgtgaatttcaaattaacctaaatgcaatattaaactgtgagtacaaatgtaggaaggtaaaattgtgtggaatatggcaaaaaaataattcctatcttacataacaaatgatattttaaaataaagccaataaacacatagttcttagaatgtattagtctgaaagattccaccttaagtgttagaggcaaagaaaaaagcagagttccagaataaatcagtggattataggacagacctcagtggaggatggcaacctttcttcatttgttcatgttctacttgatgtggttattgcaaagacaagatayatcagtagatagagccttagacagtctttcggaattaatcatcagtattacaagcttgattctggcatttagccttaaaaatgtgttgatgctataggtcttttttatatttaacggtgttgattttttcccatatttcttgcagatagtaaaatcaaatyttctcaggtatgaaggtacaagtgggtctgaaaatggagggtagagatcctggtagggagatgtggaatggctatgtaactttgagtaataaaatgtctcaatttaattaatcaatattaatgcaaagtgtttgtgtggtacaatttcccaatgctggaccacaggagactcatgacagtctgcaagcttcaagtagatatgtttccctggacacaatatcaaaatttccctagctccttgaaatgttaaaaggtatttgcaaaggaaaagaatttgatggtcaaatactttacaaaaagtttattgcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagtttattgcatcacttctcggagtctttcatatgtaaaatgcattaagaattgtctgagggtcatagtttgattcattgcttagatttatttgaccacacaacttttttcctcagatatctccaagaacaaacattctgcagaacacactgtaagaaatgtgcttaagcttgcactcaaggggtggtttaacacagtcttttaaaatataggttctgaaatcaacaggttccacaatgtgctcactgtgagattctgggcagaggaattaatccctattttttcatccataaaatgagataaaaatatcttcctcatagtgttgttgtcagagtacccgaagaaattgatatcaaaatacttacctagtwcttgtcgtgtagtaatcattcaacaaagtgaactcgtgtctgtgatgctgcagaatcctaaccatactatgctcgtgtgagtgggaaatgaaaggaaaggaaaggaaggtggtaaggcagcacagcatttctctgtagcctccttctatttagtatccagttcactcgaggtaactttgaactatttctggtttcctataaatgtggaaatgtgaagttaaggcctctgaggacagagtctattagtgccaacaaaattccaagtgcctgggagactaccacacaatgcacttgttcaatcaaatttgctgccaaaacaaatggagtcaggtgatggcaaactttgatgatcatagaaaattctaactataacccagggagtagcattcacccagggagcagcacagttagtgaaatgtgggagttagtaaacccagggagtaacacagttcagtaaactgaactggcacagtggcactggaaatcaaacaataatggcaattttcaaatttttagttcagcaaaagtcttcagcaataaactgaaatatatttgaggcactatatgctctaaagtcaatcttgatttgcagaaatcaaacaataatggcaattttcaaatttttagttaagcaaaaggcttcagcaataaactgagatacatttgaggcactatatgctctaaagtcaatcttgattgcagaaatgctaaaatagagcatttgcaatgctctaatttaatgtaaccacctaaaagacaaaggaaagttttggaaaaatgagccgaagtaaacatagagaagaaatggcctgatttctcctggatcatattgtaaactccctgtgaatggagattacagctccctattcactcctcccaaccctactcctgacacctcctcaccattatctgccatagtgcctggtgcagaagagggattgaaggctatcaagagtggtacagtgtaaccataatgaggccaagctctaagctcaaatttttgctctgctaagatttcccagccaagaccttggaaagttacttaaccaaactcaacctccatggtctagtctgtagatgaggctaatatttaagtttaacttataaggctgttatgaatattaaaaccaattactgcatagaaagcccaaagaaggccgggcacggtggctcacgcctgtaatcccagcactttgggaggccgaggcgggcggatcacgaggtcaggagatcgagactatcctggctaacagggtgaaaccccgtctctactaaaaatacaaaaaaattagccaggcgtggtggcgcgtgcctgtagtcccagctactctggagcctgaggcgggagaatggcgtgaacccgggaggcggagcttgcagtgagccgaagttgtgccactgcactccagcctgggcgacagagcgagactccgtctcaaaaaaaaaaaaaaaaaaaaaaaaagaaagcccaaagaaaacacctgccataaagttaagtgctcaaaaattagtaactattatttattgaataaggggatgatgaataaggtagtggtctaacatactttgcataatgaaggaatgacttaagaagaggatttgcgttgtaaacctgtgattaaaacagttaagaagaatattgttgatgtattcagatatttaagcaaataaaacttttggactccaatattaacttagtaattgatattattaattcttaaaactgaatcctccatagaatcctaaaatttgtcatggactataacatatatcacatttaattttctcaaaggtcttgtagggtacataaaggagggactgcccctgattttacattaaattgcttattaggtgagagaatttttgtgggaccagaggaagaaatgcgttatatgtctcagtgctcttggcataattgtgtatgcagagtacatcttattttggtgatgtttttgtatgaaagacttttgagctcattgttatgactcagcaaaactatgggttgtattagttaatctgactcattccttaatggacataattattttacaagggtaaatactgtttctccatcaagactggttaaactattccatgtataaaggtcagctacatcagttttggttagaggtgtggacatttaaaataggtggattaaaataaagaatattccaaagataattgcccaaaatatccaaaccagtatttgcagctcaagtgtatacctgccgtgatggttatctgaacatcattttgtacctttgtttgcatttatttatgttttattttatattaaacatatgcagcccatgtaagtttcaaaacagttaataattctatcttctcaatgaaaaaaaaatctgattcctagagctctaccctttcatttttactcattatggcttctctcttatgaaggattttctgtaatcaaatatttacgtgagacttgtataaaaattattcttcgtagacaaaaaatatagatattggtagaatatggccaaggaaatgttattttgaatgtaatcctgaaacatctgaatatgcttgtgtttaaatgtattaytattttaatttttaggaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcagtaagtagtctgcagcagtgtcactgctaagtgggaytgatggccagtaccagaccatgttctttagaaagaagactgaactctctgtagtgtctctatagcaggtatctatataaggggacttaaagagatcttcattctgctcatatatactatcagcaaagaaaacaaagagtatgaaattcaaataggagatttgcagtgaggaactaaaataatattctctgttactttgtcatgtaaaaatgtcgtgagctatgaagtactactactgataactagcaggtgatcttaatttttactgacatgtacaaataagtgttgtgtgatacatacatagatatatgatatatatgtaatcatgtatatcacgcatacatatacatgtatttggctgaaccaaatgaaattgccattttgctgcataataaaaaaatataagcaaattcaaactatattttaacagaggtataaattttccatttatatatatccacatatataaatatcccatatatatccacatacaaatattttatatattatatatattagagatatagatacatttccatcctgacctttattgactggttattgatttagatttcaaaaagtattcacttgctttagaaaattgtcctaaaattaaaaaaactcactataccctgaatgcttatgtgggatacaccaaggggagaaagtagagtagtgatggaagaagagaaaattgtagaagaaacttggaataattatagtcactatgacaaaattactttgcctaatgatagcatatagttaatgttactgtgcaaataactgtgcaaatgaatgacttgagaagttataattaaagtatttcatcttttaaaactcaaataaaaagtcccgcctctattacttcacaatattttagacactacagggaacgaaacaggtctcaaaagtttcagaatgccagtctttcagtcttttttaattagggaagaaggtttcactttacaactttttcccctctgctttctgataacttgacagcgcttagaaattattaaaataaatagggaagaaggaaacccagagggccttccaactacagcaagtaactatggatttttcctgtttctcttgtaatagcctatgcaactaagtaggtctgtccctcaagtatttatacggacttcaaagctcctatgggctcatgatgcagattcaaagcatgcttatactatcaaaggaaacctttgttccctagaagaaccttgtaagagcatattacatgtttcagttgattacctttcagcttagaaggcactttccagaaaccatccacacttctcgatcgttgtatgaatcaaaccaagtgcaaaccaagtgtttgcagtcatgcctgtttccataaaacatcccaaatagtctgcatcctgcatttgccagtggcccatgtatttttttcttttcttctatttcactttcatgttattagaaagatgaatagtgcactgctcaggacacttttctaaagcgagtaatcaaaaagttttttggtgatagttataatgtcataatataaccagacatcaaaaatggaccacagtagctacagaggttaagtcacagcactctaatggttatatgtattaatttgtcattgtcaggtttcatttttaaggtgttaaaattttcctacactgagatggtaatatacaagggagttgagaaaattcagtttgtttcatttggaagaattatttgtgacagttttcaaaacattttgtaaaaaaaaaaaaaaaacattaagctattcctcatatgcaagaaatcatacctgtaaatcaggccaaatctgattttttcagaaatctgaaaaaaattcagctggcctaattcaataaaatttatcagctgatttggaatacagggaatttctattattgtgaaaacaaactcacaccccacctaccgccaacacccccctactcccttctctttttgatgttgttgaaaacaaagtgattctcagaaacagaatttgcattccaggctgtgggccagggagaatttacatagacaagttacacactcttgaaaatggtgttttatgctagaaatcgtgagaccctccaaatccagtaaaatgaacagcaaagcttatgataaagacaatgtttacaaaaaacatataggggctttggtttgtttttttgttttgttttgttttcaatgaatttactttgggtcactttctgtgaagcaaaaagcagctgtgacagggagactttcattctctgcatgtgtatattgcagtcacttaagagttactaagcccatcaatcagtcctctgtttccctctgttgaatcacttagcaacgtgcaccgtgtaccatagaatcaagtgtggttaatgggagccagtctcagatcaggctgctgctgattgccatcctcatgagctaagtcaaattgtttttattctaactacagcccctggcaaatgaccttgctatctttaatgcaggtttgcttgtttaattttaagctattcctcatatgcaagaaatcatacctatgaatcagcccaaatccaaataagtggcattcttagtcaccactaatcagcttttttcttttagttgaatggcatcaaaatcaaactgtgtttttatttagtgcacatttgaggttaataaaaccattcagaagcaagtgtcagcctttaaaggtgcccaaagattcgttctagtgattgtgaaaaaggtctagaagtcaaatgggtacccagagagccagaaggctgttggtgagatggagcagtcactgagcgggtcaccaggagaacttactttatgagatctgctgctaatttctgactttgggcaagtcacctcaccagtctggggctaagattcactcctcatcagtaaaatgaatactttggatgagacgggaggttttcccattctgatgctaggatcttgttcatgagttaatgaagacagttgaggaaggtaaggagctatttctacttgattagtgaggcttcagtctatttcaacatttcaaagtttttcatgataatttgttcatgaaaaaaaaaagaaaacagaggagttgctccagctctaaaaaaaatttgaaaaccacaccctgtgctaattgcaagtctagtctactctggtgctgctctgtggtattgcagacatagagtctgctctgtggtacatatggaccaggtcttatgatgatgataggccatgtttagtggcttcacacagaggtacttcagagcttttatttggattcctcccacttggatactgttctgactgctttatcaaaattaagtgtctttgctttcaccctcctcctraaagtcattcaacctaaaagtaaaattttggggggcattgaggggggargaagcagaaaatgttctgtttaacaatgagatctacaccagatatttcattttgattatttaaatataaaagataccttttgctcacagtagttggcttaaagtacttcatgatttatgaggggtgattgctgacaaagtactgggaggagccgttttgagtcaacacgaccatttgcatctgccttcacttgctctcctctcttattaaattgagctatcctatgtgtgggtttttatagtaatactagaacactgtgagtcatacagagcagttgtgccgtcttcactacattctcaccttgctgtgagctggctacatgccaaaaaatatacattttagtaggttgctgatttttagattctttgaaggctaatgttcatagctcttactagcaatagtctgggtattagaacaaaaggagctgtctatttcagtatatttctttctgaccactccccagccccttaccacaatttcttctccagctataaaatctcctgtataactgcagatgatataaaacaaaaagaaaagtagagggaaaagtaagggcactatttatgaaatgttttaattgacactaaatattacatgtagcttaacttttcactatatatgatcagcccttaatgggtattagtgaaagccctacaatttacttggttgaaagccactatccatagcaagctaacacaggaacagaaaccaaatactgcatgttctcacttataagtgggagctaaatgatgagaacacatgggcacatagaggagaacaacacacactggggcctttcagagggaggagggtaggaagagggagagaatcaggaaaaataactaataggtactaggcttaatgcctaggtgatgaaataatctgtacaaaaacccccatgacataactttacctatgtaacaaacctgcatttgtacccctgagcttaaaacaaaagtattaaaaaccgaaaccatttgagtcttagcattatatatcattgttcaagatactggcacatactacatgttgccatgaatatcagctgcccctgtctccaacacacacatgcgtgcacacgcacacacacacacaccttgtaaaatactatcagatttagaataaacactgtaagatatttttaatctccctattctataattttaagctaccatagtgtggccctattataatatagcttctaactacttaagatagccaggtcagcaaaaaaagaaaataaacaaaggcatgatttttccatttgataaatattcagttgaatgatttagagaaacttagccaagaagactcrgaagcaaaatttggcttaaatcattgcccttgactaaattactttaatgatgcaagtaaatttgtagcattgcttttcccttcaattctatacttggttatgaatctttgaatcatgttaagatataattcacatagactattttttaacactttggaatcaatatgcaattttgctaaaatagtgcatgtcctcttttatggtcctccaactaatactcatcaattgtcacaacctaatataaaagaaaattacattcaagatacatagttaatatagaggactcaaaacaaacctttaaggagaaaataactcaggaaaatgaaataagtattaccattacattcacaatactcactgtgaccctcttttccaaatagaaagacgaatcataatgtaaacaggattaagctttaaacatcctttcatcaggtttccttaggtttgctacagtttcatttcattgaaaaaataaggaattttataaagcatttatggcaacaaaacacacatgaccatgagtaaaggaccaaacactgaaatacaaagtgtttatgattatgggtgcattgataaaacattacagggtttacaaagcaaagtaaagttatacattttctattagagaaagagtatgtgcacaacagtctggatattttactttggtgaactggaaagtagtgaaacttggcaaagcgacccaccaaatctgtctatttagaacctaaatttatggggagaattgtcaaatatcatcacatattccaggcatagtactcttgaaggagaaactaagaatgttttgaccttttttttctgttcattttgactcttcattggccacgtaaattaactgcatgtattacawctattgagctctcagagagggtgtcactaaataactgatttcagtttccagaaaactttgacttacttacaccccaagaattttctttttgtttaaatatttcagatgcattcttctctcaaatgtattagatatttgcctttttaaaacgtggattccaaataagattcagtgtttcatcaataaatcagagttccaattatgaacattaataacattctattaaaatagtgataatgtcaaggtttactcttaygtgaaaggctttaacccccacacaatatgtttcccagaaactggtgtctattttgagaagcttttttttcttggtcaactttttatcattttatggtcactatcctaccaatcaggtagtcaagtgtcacttctagtttgtgttaatgttaattttctctgttgtgtcttcctatttttctatatttattttttctattgttctatcttgcttatgttttgttcccaatcagtgtctttggaaactagaaatcatcattgtgaaaattgtatttgtggaattatatttctagaattaatagttaagtaggccctcttataattaaagagcatgagttcaacacatgggaggatttattgtttttgttcattattctaatatctcatgtaaagcatatttatgaggggaaattaactctagatattaacctaaagaaggttacatttgtttctcatataatctaaagatatccattttgctaccgcagagacattttgtcattttccctgttttctataatgatctagggaggtaacatgtctaataactgaattccaaattgagtaataattatacaaaagccaatttagtttagtttggtaatcaaaattaaaagtattaggtggtaaacaataagactataaaagaaaaagtagctgattgtttaaatacatttgcttataagaaaatagaataattttggtccatgagactcacaaacatcagtgacaatgaggcaatatactttttgtgtaaactaattgttggagctatttaaaaagcgcaaaatccatcattgatagaaaatagcagctaagaataaaataacttaaaatcagtttaaataataaattgttgctgcaacttttaatcaattgctcctgaagtctttattaaaatttatgtttcttagaactacctatatttaaaatgtttttgtccatcatctcaggttccacatttgaaagattttctcacatttacactttcatattgtgacttggcttaagaggtaaagttagagatatttcagaaatttgggtttataaattccttaacttgctttctatttcccatgattttagaacagtgtttctcaaactttatggtgactgagaatcccctagaaacttgtttaaaatgtagagttatgggattttttttttcaggaattctgattcagtaggccaaatagggctcagaaatctgaattttaaacaagtatctttgtgattctggttcatgtaaattaatgtcttcagttaatgagctggaagttactgataagtaagaagtgctcatggtaatcaattagagacaatatatcctatataggacattagcccctgtttcactatcaaatccatattcactatttataaagcattcagaaagcattatttatattttattcaaaggaattacaagcactgaaaataatatttaagataataaatatttgaaggggtagacctatagattccccaagtccagattgtataacgaaatctatttttattctgttgcttattcttctgtattgagtaaatgaattgtttttgctgtgaatcaaatcacagaagtcccgtttttcttacatatgtacttaaaatctttctctgcttaactttagagcaaccatctaaacctgaaattgtaagcaaagcactgtttctcgaaacagagcagctaaaaaaggtaagaattgtttttgattaatacctttatttagccagtgttgtaagtgccttcttctgaccttacattccaagacaagtaagaaaggctttgctcttgtggagatgacagtgttgcagctaccaatcagaaattatctacaaggcacagagggtacaacatgctcacagtctcaggtaaccatgaggacatcaaggaaggtggggtcatttctgaaaagaggagtctttctcatttgaattaatggattgtttaatagaaggatgaagccagttagcatgattcatgcctgtaagcccaacagtttgggaggttaaggtgggaggatcacttgagcccaggaatgtacagcatggcaagaccttgtttataaaaaatatttaaaagttagctgggcatagcggtacatgcctgtggtcccagctgcttggtaggctgatgcttggtaaggaggactgcttgagcctaggaggtcaaagctgcagtgagccatgtttgcaccattgcattccattgtggacgacagagccagaccctgtgtagaaaaaatatatagagagaatgatgaaagatgaatagattttcaccaagccaaaggtagaaatggctttccaacaatatgaaataataggatgtgaaagagaacggtgtgtttgggaaacagcaaattttggcattgatgaaactgggtgccaagacagaaaacaagaaaggatagaaagagatgaatctggagaggcaaagaaaagttggatcatgacaaatcttacatactaaatagggagtttggactttattctgttggcaaattatgctactgaaagattgaagtaaagaggtgagatcagattggaacaacacattagcagatatgtgaagggaagctgtattaaagtgggggacaaagttggagttccatattgaataataatgtaactaaaataccaaagttttcctttgttgggagatggaaacccaagtcctacattctttgtgtcatattaaattttactgcataaaattatttgatgaataccaaatattaaagttaaaatacatttaaagaaagtgaggggaattatagagcatgataatgtatatcctcttgaaatatatgtagtatgaaactggagacacagccccattttaacaccaaattattcttccgtatgaagatctatgattcatggtaatagtcagtgttaatagagtaatgttatttggttaatgttaaaaatgaatagtgtcaaaatgaatttggcaatgctttcaaatgaatgtgattttataatagtgacaccatctattgcacatttaaaaatcgtcaaaagtatattttcaaataaattgttaaaaaggtcttaaaaagacattgtttttataccagagagcatgtattcagtctttggtcagtgttggaaaataaacgggtcaagaaacccttggaataactctgcattgcctgastttctggagtttccaaattgacagcccctgattgaaccaaggtaataacattgcctttttattttgcagttgggtgactgcatttcagaagacagttatccagatggcaatatcacatggtacaggaatggaaaagtgctacatccccttgaaggaggtgggtgtgagggcaggaggacagggagtacattcagaggacctgttctgactttctttgttctaggtattctttaaaccagtggtctccaacctttttggcaccaggaactggtttcatggaagacaatttttctttggatcagggtggggagatggtttcagggtgattcacaggcattaggtttattgtgtactttatttctattattattacatagtgatatataacaaaataattatgcaactcaccataatgtagaatcagtgagagcccagagcttgtttttctggaactagacagtcccatctaggggtgatgggacacagtgacagatcatcaggcatcagattctcataacaagtatgcaacctagatccctcatatgtgcagttcacagcaggatttgcattcctgtaagaacgtaattccacaactgatctgacaggagaaggagctcagtcagtaatgtgagccatggggagtggctgtaaatacaaaagaagcttcttgtggttgcccaccgctcacctcctgctgtttgcacccataccagtcctggaggttggagacccccgctttaaactattcaggatctaaatatgttgccctcttttgagctatgactcttatgctctgttactttaagtatgtactaaattaatacatgattttttaaacatcattttcagcccttgtacagaagaatcaagagcagaggaaataatttctgtatatggcatgatctagaagttaattaagtgagtgggaaaagggattccaggattctatttctgtgtctctgattcacggttttgaaacgacatctaacctcactacatgtcaattttctstcctgctgaatacagttagaaggaaaaaaaacacttctcaaaggtgtggtgctgtttcgttaaggattgtgattgtcagatgaaagmccctatcatcagtgttctttattttcttcagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactgtaagtaattcaatatataattatgctatttaatgtattagaaataatattcaaatgctattaatctttgaggtcccaatccaattactctttgaattctgcttccagtctgcaccccaaattgatggcacccaaataatctcttcctctttaggagaccatagcatgaataaacatttatccatcctataatatctttcactctctacattttatctatgagtgtctcttctgaattccactacacactaagttctttaaagataagatctataacttattttctggatgaatgacagacaaatatagactttaactggctttctaaataagagattaccattttaatgaagaaatttattttaataataagatcaattgcataagtttgataggatgttgtattacaagacattttacttaactaaattgtgtatttgaaacagagtatttgtctacaaaggaatcttcatggtcatctgttctaacttcattattttagttagtaaagtgaggcacagagtcttgccctaaattagctgtagatattagaatagaatctttttctccattgctgtgctttccttgtaagacaggtgccaagataatctaatgattagaagcaaaaattctggaattctagtcccagcattatcaattaccatttcttgaaaagtagcttaattactctacatctcagttttcttactttaaaatgggaaaaatataatacctaactgatagtgttgttatagagagtaagtgaaatcacaaatcaaaaatagcatgctacatcacacattaaattgtcattattaagtactttattattattattatatggtcattatcacaatataaacatagagctgaagatatttggggggaaaatgcaataaaggattttcttcttattattaatttatctaaaatttttgtgatactggcatgtgttctacagtaacctagcacttctacatctattttagagaaaagccaggaatgcctgctgagcctttygaaagaatcacctcacctacatttctttttttggttccctagggcacaatatcttatatgagaacaaaagtgaaattcttccaaagttgccctaatattaaaaggtagttttgccttaaacttgggaaataagtttcaacttgatttaaacccaagaaattaatatttcattatgtatagcttatctaaaatcaaacttttttaggtgaaggcagaattctttctttcttttttttttttttgtgtgagacatagtctcactctgttgcccaggccagagtgcagtggcgtaatctcagcttactgcaacctccacctcttgaattcaagtgcttctcctgcctcagcctcccaagtagctgggattagaagcgcatgccaccacaccctgctgatttttgtatttttagtagaggtggggttccaccatgttggtcaggttggtctsgaactcctgacctcaggtgatctgcccacctcagcctcccaaagtactgggattacaggtgtgagccaccaagcccggcccagaattctttctgttagaaatattcaattggaaataaaccatattagtgtaagtgtaggtgtacaacacaggagagaacatcaagataagtaataagaattgggaaattggcttcagaaagaatagaaatatctgtgagtatgaggcatgcagagttgggtagacggagaagttcttgaatggatacgaagaaaatgattttatcatgctggctgtgtaaggtgcacttgtcatggcttttaagaagccacagtgggcttcatggtgaaaacacgaagcacaaagaagcagtttaagacagtcctcacattcaaggagtgtactactccagtagagaaacaagacacctacatcagaaggaaattgccaatgcaaggttgtaagggtaaaagtcttaggaactcagtattaagagtcttgagggctcaggtgcccaaggacagtggttctcaaactgtagtgtaaatcagaagaacatgaaggacttgttagagcacagattactgcaccctggccttgagtttctgatttagtgggtataggacggtgattgacactctgcatttgtaacaaattccctgatggtgctaatgctgctgatctgaggactacgagtggagaaccactgctctaggaagacttcagagaacagaagaagagtgctaaatggaaaggagagacgagtccatttcaagaaaaaaaaattggccaattcatcttgagaaagcttgagaaaaatgcaccthttcaatcagtaacgaggttttagagaatctagctctttaatctttgttttgatctgatttctgccttctgacactgcctacgtttatgccaccattcctcattgcctctattcctgcgatggatttcaaagtagtatttttccaatgaattgcaaaatagtatttctcttgtctgcccaccattctctgttcacccccaaataaactgccctccaaactgctgccagaaatatttttctaaaacacaaatgtgacaaaaacttctcagtgactccccagagctctcagattaatatccttccccctcccccaattgcagtatgccttgagttcgttttagccatggtcctacagtatgtctcaaccctcatcactgcctgtatccactgtggtctgttctactttccagattccttctgtagagtaatacttacatgcctatgcatatgctgtcattttcccacctttatcatttagcaaayacccatttatgtgtcaaaacccagctccagggtcagttcctccaggaagcttcctagtctcatgtaatgatggctaccaggatccctatgcttgtgtcatatgcaggttttatgtggtcatactcttaattattaagtttggtgtctttacaaatagaggaaaagttcattgaggcagggttttcaacttcctaattccagcacttaaggcttgcacaatatagatgccaaacaaatgaataaatgaagaaggactgtaggataaataaatacatgaaaagaaaatttcagcagacagttttggttattttgtaggggtttatgtagcagagtaagagagaagactctcacttgagctgggttcaagccaaattgtggataccaggctaaggaatttttatttttaatcttcatatgttgggaatgtgtaacagattttgagtatcattgtaatattcaaagcgctacttcagaaaacagattcagaggaaatatatatgaaaggatcaaaaggaaggagactcaaggtgaggaaccaagtgaaatttgatggcattgcttcaagtttaggttaattaggacatggactagggaagtgttagtgagaatagaaggggagaatcagacccaaaatatattgtaaagtattaatcatcaagacatggtgactgaatggataagagagggcaaaggagaaagccagggcaatgggcaaaatgatgatttactagtgggcagagtaaaattcaaagtcaggggcaaacgcagagcaagggatccttaactttgaggtaaacacgttagtggacatgcagagagttactgtcaaaacgcaaatgtgttacattaaccctttgatgactctctaatacaaagcggagcctattgaaaagggaacacagagaaggggagttttaaaatagagaaggaagtcagagattgccatccctggctgttctgttgtgtcaaccttgatcagagatgtgccacagtgacatgccacaggccaaacatgagcactagtcagagaagggccaagtaagaaaagcaagagaggcccggaaacggaaggtcagcagggcaccaaaaccagattttatttacttttcaacctcaccggaaactgctggttaggaaactacttcaggcaaatccagaaaaacaaataagaaatgtattaaatcaatcaccgtttaacctcagaatgtactggacaagtattcagagatgcccaagcatagagaaaaggcaaagaaacaatctataacaaacttctaagtttttttatctgcactttatctatagaaaggtaaataaatgaccgcaagagatagaacaaagcctccaaaagtataacttactcatttcacttgttagctaataaaaaaaataggttttcatagataatttttagtgccaccagtttggaaatatatacacatgcctcaataattattaagtcttgtggaaaacattctataaaacatacctttgcattatatgatttcaaaatttattattcattgtattatccagcaacataacaaatggataggttagtggatcatttctaactgccagcaccacttcattttatttcctgtttgctagatatggttcactgtatccagcatttaatttcattagcattctactattgagtgctgaagcataccctttagccctattttctccataaattgaccaaaatggaatgaaagttgcatcttggctccaatgaacaggacaaaattacaatacacttacagtcctgttgattgtgtcaaggttctccctcagttcataggattcatctttttttaagcagatcttctctcctgcatgccraaatcctcgctggtgttgtttagctcatgtctcctctttttatttcatatgaagtattatcatgcaatatgagtacagtggcatctaatagctttagctatttgctagctgatttttrtccttccaaactataagattcatataatatataattaaatttccctatcataaagccatgcagtttgattgttcctatggtcttttatacataaaataattaccaccattcctacctcagttaaagacattttgctaagaagaaattgatttttatgtaacagggtttctttgtagttggccctaagattagtacttgtatagcaagtagctattagcttcaatccttctataaaaaggtatatttaagcaattaccattactagcttcttgagaaaattatgtatartttagtcatttacattgtatgcacagagtaattcggtacttgacaaaaatggttaacttgtgtctgtaactcttacagatcctacagagcaggtgacaatacaagtgctrccaccaaaaartgccatcaaagaaggggataacatcactcttaaatgcttagggaatggcaaccctcccccagaggaatttttgttttacttaccagtaagtgcttaagtattacttcagytggatgactatcatttttcctgttgtttgacttctacatggatagattaagtgagaaaaaatgttattgctggagacaagagacgccacctataaaatgtcacgtggaagctttttctgcacctgccactgttcttgccttttttctcaatgctgagagatttcaaggacaaagagaaaaaaaagccaaccacaggaaaccataattgcaaaaacttaaagtttaattatccaaataaactttaagaatctgctcctcagaagcagataactacaaaatgaaaactgatgacagtgaatgaactgatgtggattctaaatctgcccacaacattgccccgaacacacctctaaccctcagaagtagggatagttctgttgcacgttatatttaggataatgctatggctcttttttggtcattatgtataatcttgaaatgccatttcctcaacttttctccatatcatagctgaaggaaatgatatgcatagaggatactttggaaaattcctctcggatgtgctctgcatgtcataaggatctggaagcagacaaggagagagctcgctctgaggatgcctgtttgctctcgcatatctttgtgtttgacatcactttcacattgagggaagccataatgcaactcaatactgcatttactgcagggttgtgcttacaaatttcatctaccacagtactcaatagtatttaagaatgtcattcactacattattcagaagactagtataagtaatttctttatgctgacagaaaactttgtttctcccaatgaattaattgctgtttttgtttcctttgcgaaggaaaatttaaaactaattaggtttctgctttggctatcggggatgacagagccaaatttgtgtctcagttttagcaataatacctgctgaatatctttctttgttaacttatattattcctacatcatctatatttttcctagtcttaatttcttaatttctttttttcttttgtcattttctttttttcttctcctctctctcttcctttcccctttctttctttctcattcttctcatttcatcctttcttcctttttactttccttccttccttctttccttccttttatgttttttcttttaatctggatatatagtgtatttccttttaagctgcctcaaatatttttgtcaaattacataaggcataaatataaaaataaaacattggactttttaaaaatgcccttgaaacttgagcaaaagccatgctgtcaataaaataaaagtcatcaatagaaaataaatcagctctcaaattccttaggtccaaaatattaattatttgcccaggaatcagatattggtaacacaaactgtactctttttgtgtgatcaatgaaacacattcccttttttatcttacttgataaaatgctatcttcatcaagaaatacaactgttctcattgtagcgaccaagtataatcatctgacattttgcctctatcaaaagggacagcccgaaggaataagaagctcaaatacttacacactrayggaygtgaggcgcaatgcaacaggagactacaagtgttccctgatagacaaaaaaagcatgattgcttcaacagcyatcacagttcactgtaagtcacctacttcttcatcagcagcttcacctcaaaggcttctaatagcttaatgtagctatcttttcaaataaactgcacgtatatctttcttaaataacttggttgcaatagatgcagtagagagagaaagcatcgggataagctcaactttgtccagatttgtactgcaatattgaaaccttkcatggctctgataaccgcaacttttggcagtggtacatctccatcttctttctaagtgtcttcaatttgtggtgtcaatgaacaatattcatatagaccttaaagaaacaactctgtatattttaagaaaacatttccatgttcttgaagtgcaccagctttgcagttgacccagcattatcatttgtgttacagaataaatttaacacccaaactcagacaatacaaagttactacagactcagttttgggaacaggaagtagagatcattagaagttatttattggctgaatgtactctatatagaggggtaggaaatttctggaaacagaacctcttgaaaatcactgtggacataactttttaacttttaatttgcttttgatctccaaatactccaaaaattatatttgcctcggtgtaacagaaaaagacacatgtaaataccagacatttaacttgagttcttcatgacagtccatattattgatgtacctgatgaatcatggaaacagtaaactaattcataccacaccctggtgacactagaattcagagtgctttaagcaaatgtcagtcttgcttagaggtatagtacaaacttcctaataagtcctttgcactcaacagtaccattaataaggtttcctctagacatcatccactacaatcccactgagtataaagagactttagaaattgtcttgagtacatagttctaactctttcatttgactcataatactttaaaaacatgtgggatatgagctaaatttttgagagagatacagggaggtacattggggaataaagcaaccagatggttgcttctgattgtctgatgttgggagtgctcccttgagagccctgtaaaaatagtggactgttatgttcacagctgggccatttctccatttactccttgcttatgttgcttgggtttgaatgtgtctmccatcaggggctagttacagagaaagcagtagcttccagtataacaatattatccagtcctgttccatgaaaataaaataatgaagaaagagaatatagccagcagatagaaccatatgtggaatagctagctstctattatcattgctcatgatgtctttgggccaataatcaataatctagtgccttagagatggtgtgatgtgcttatttttaagagatgcaaggtacacaggtctctaaaagaaaagggctcttatttactttacttgtagataaggcaggggaggatagatggcagactgacaaagcaaaagacttggttgcagccatatagtgcctacgtgtttggctgtgatgggggaaaattaaacaaaagtgtgtaaaagtttaaytggattttagtgcatttaattagatttaaatgcatcttggttttgacaggtagactctaacactgggttttaactctgttgctgactctgttcctcctcaaaagctgaaaaaaagtatttcaagtaaatcaacatctgattctaaattatatggaaacataaaaatcctatttttacccacttatctttgattgcttgcttattttccaaaaacaagatttgtttccttttcaaacatgtctaaaggaagtgtgggtagagaagcgccaacccattcttgcacatgtttgcagaatagactgctcatcaagtctcacagcctacaaattcctagttgctgatgaaagtcactgtttccctgccaatatatgcacacatagagtcttcatcagagctttcaaagtccatcattgtcctgtaaaattgtttatctcctctctggaaaattagctatccagctaacaaaaacttctaactcatccagaataaaattttcatctaaatacaattcacccaaatgttccaaggaaactccacttttctacatgttggtacatggtttcatattaatgagaaattgagaaagcatgctccttcccttcattcattcaatagtaatgtttgagagtctaccatgtctcagccactgtggatatatcagtgacaaaccaagtcacaatcactaccctcatggtgctttcagtctgataggagagacaaactttaaaaatgatgttgcagtcaacaagttgcaattatgacattttaaaccaaggagaaacttggagtgtaatggcaagtcttcatactgtagaacaaagacacaactcctagtgtggcaagcatggtcctcttcagtctggtctcaatgaattgtatgagtttaacttccatgagttgtcaccacttatacccaattactcaccattacaaaatctgccaagctttctcatctcttcrcctttgcttatgtgaccaaagttttccttacatcttcccctatcaaagtccttctcaaccatcagaggccacgaacatatagtgttccctttacaaagcctttattactgctttgaaacccagtttggctctgttctctatacttccattaagtcttcatttgtacctctgtttctagcctgcctttcatctttcaacaaatatttagtgaactccaaatcagtgtcaggtttgctactaggtgctgattttatgggctgtgtgttatagtcagcatagtacctctacctcattgacttataaggtcattatttatctctgcatctctcatcagtgcttgggacttagtagctgtacaataaatacttgttcagttgagttggaattttctcatacagatcagactatgacagtaagatttttataaagattgttttccatcaactggatgagaaatggaatagcactttttaaaaatatctgctgctatagtaaattctctctgaagaaacacarctactatctcatggtttttcaatttatcacctgctgtctaaagatgcttgattttccaacatttatgccttactgtctctttatataatatttacctagtcatcatctttattttcttccagaagtgacttaagatttttttttcttaaggtgataggccctaggggaatatttatatcccctcaaaatatcaatcacgttaactgcaaataaatggataatcaattagattgaccactctcttgtctaaactagtctcaaggctggcttgaaaaactaggctaatcatgctatagtccaattattttagtcatataaatcagttctgaatgttcaaatgcagttagaagaaatttattttctttcatcttttcttctccaaaatattttgactatcttayatttcagagttagcactttgaacagattttctgcttcacagatttggatttgtccttaaayccaagtggagaagtgactagacagattggtgatgccctacccgtgtcatgcacaatatctgctagcaggaatgcaactgtggtatggatkaaagtaagtaatatttttggtactaccctgctgtttggtttgatttctttttaggtttcttatgcactttatattgtattcaagtaggtatattcatggatgtgtttatataccagctctctctctctctctgtttctgataagagaaataaaataacaataaaattttagaggtgctcaacacggtgacatccataattggtattctgaaacttagtttggggtgttatgtcaattatgtgtatatactaattatacacacaccacacgcatgtgtgcacatacaaacatagttatataccacagggcttaataatttacagtgtgtttttgcccacattatccttacgtgatatttacaacaaccctgtgaaatacaaagattattattttccccacattcttcatataaagaaattgaagggaaataaatcagaaagctcataactgacagagtagagactcaaggccagaccttactgagtatgaatactatgctttgataagacaccttttgtctctctgctgctgagaccactcttaagtttctgaaaacaggttccactggatcaagggctcctagaaagcaatcccttttatccctgagctatagtagaatacctggaacatagtaggagttaattcagtattccctgaacaagtgcttatactcttgtaattgtctgaaatgtaggccattggctatccttttagagtaaggaagtgtgactgataattggtgatttgagacaaggttatcaccaaaggaaaaggttrtgattgcgatccctccacttaaacccttggctagtatatccaaactcccagtgcatttgttaccagagcatgacatgtgacaagaacccttaacccatgatgggttcagaaaacacacataccatttgaaataggagttgacaagaattacctttataagaarctgtggagaaatatttttctagagtttctttttgatggaaatatattgatgaaattattttgtattgctttactgcctgccttttgatcctttttaacactcgatcctctgctacttgttgtcttactctgtgagctcagtttcttattgtactctctttcagccacagcctcatcacaacttgttcactaaaataaagtgccacttcctatgctgcaatctagcatgatatgtttgtagtaatcagtgatcacaaggctagacaagttctaggcaactagactaattcataatcatttgaacactcattgcatgttttactataggactagagaaactaagtttactgtggtttaaactgtttgtacaatcaactgcaatcactgttatgaattaactgtcatgaacagctcatgtattcaaaatagtgatgatcagtattccctgattattggttagttaatggggagtgggaaaaaatatcctaatggtcaaagaccacataatcttaggattgtgtctagttgcctgcttaggagcatttcaattcctgacataataggattattttctgtatatcaggctattttttaaaattaaatgatacatttcctttgttcatagaaattggaatagaacgctttccaaattataaattcagtaaatgaaagagcgtgaaataaaaatctgacatgtctgactctaaaacaacaaaagaaaaaggaaatctattttgaaagcatctgaagttaagaaaaagaagtttgcatttatattattcccagaagaattgttttaggcttaattattatctaataaatacactgagaattttaattctgccacatgaggtaatttactttttatttaatcaggataacatcaggcttcgatctagcccgtcattttctagtcttcattatcaggatgctggaaactatgtctgcgaaactgctctgcaggaggttgaaggactaaagaaaagagagtcattgactctcattgtagaaggtaataaaatacttgggcactaattcaaattgttctttgagaattttttacctggyttcttttatgatctcagttcaacatcttattttaattgtaatatttcaggcaaacctcaaataaaaatgacaaagaaaactgatcccagyggactatctaaaacaataatctgccatgtggaaggttttccaaagccagccattcartggacaattactggcagtggaagcgtcataaaccaagcaagtatttgtcttcttgttatatgctgcacttcgtccaatgcrttttttttccttcacgaacctaccctataggttggtttgttaccacataaaatttgcagtgtgtaggttggkttgttaccacatagaatttgcagtacatgctcagaggaagcttttgctaacytcttaattttcctagaggaagaacatggctcaaagagaaattttatcccagggccatggagaagggaagaaccattgtgtcatggtcagtatctgtttttaaaagaatataaattaggtattacttcatgatcattcattcctaaaatgtgagtgattaaaacattaagatatacactttcctgcaaaataagctcatgcatctcagtataagtgaactctaatactgtgctcaacttatgcacattaaggggtgttacttcttaaaactatgtcctcgtgtaggaatggtggagaagaacacagttactgcttatgaatgtgtggtctgacatgcctatgcagtgctagggccagaataaggcaagctacatatatagtgcctaggatgtgcccttctgaacaaaagggtcataaaccagaccttaatatttgtacctttttattttagtaatagtaaagggttaaggatttgttaacactacctgttattttcttttactattaagtctttgaccctccccttaaaggaaaaatgagaatctggcctaccactagggattcagaactgtaatcccagtaatttgccaatctgcttgggttgctgacatacttgctaattccattgttctctacaacagtcttcgtgtctccctcttctcagtataatctgtaaaggcttctcaggagcacccagaggtaccactggattatttaaatcttctgtacttctcagattttgacccagttgaaatttgagaagacatatataaagcaaagagctgtaaattaattttaagttaaaatctccactcttcctctttctagggaagttgggccactgtcccagcttacgccatgcagttttgcagtgcaaagtggattttggctctttcaactataggtgatgcatatatagctgcataactctagatatggaaagccctcaaaagagtaggcacacktgaagtgaatgactcctgatttggttaagtgtgatggggamacacagtaagaaagcatataagaggaggcaaagaagctctgggctcctcaaacctaggaaaatgcagttttcttgatttggaataaagacttgaaccatctaaattgctgacaatgtgcagatctatttttagcatcaaaaatggtggtttcttttctactctattgtttttgctctctagttcaattaagtgataactgcagcaaaaaagaacctttaggtactggtaatacagacatagaaaacagaaacataagcagacagtaagtttttgattaatgaaaagatatgaagatttaaaagaccatcctagaaatgagaaaatatattttgtagagtttaaagtaacaaaaacaaagattccgtgagaaagtcagatgaaaaatcctagtacgaagtgaaaaaatagcaggtaaatttactgtgaggataaaaataataatgccatctttcattgtcaaggagaaagattgattctggcccactgggtgatatgttatttttcttgttctgggatttgtgctgatgcatccataatcacaattttatttgttcccttctcagatacatggtgaatctgttattttacaactagaagatgtctctgcccctcctccaccccagcaactagaagataaccaaaacaggagaatagctcttgtcctcaaggcacttaccatgtagttgaggagaaagcaaacaatatagaaagagaaaaatgtagggaatgagttcataagatgaccgagaaaagagtgcaagtacattatttgcctcaaccttgttgggtttaggagtcaaatcctagggatgagattaaagtaaattgtattttatatttgaaggaattaaatgcagtgattaccctcattaacacctcacaaacatcagagggacagcaatcactgaaaaatcatccatcctctgtatttacaacagaaaactttagaaaaaaatggtttcatgtacccatgagcaaattatacatacatacatactttgatataatggtttaagataaaggaattaattcccacagtgaagaacagtgactaaatttataaataattaaattcatatatttattggtggaaagttggtgtttaamtagtcaccaattaattattttgaaacaagtatcatcaggccaaaatgttgactaaacctgagattctatttaaaaagaagagtttaattaacttaattattagaattcacaaaagaaacataaacagaaatttcattatggatttactaatctttgtagatattggcatacatgggtcttgatctatgatcttacatagcttttgaacaccagaatgctctatagagcaccacgcctatcctattacagtcatcattactctttcctatgctttttaatccattttgatttctaaacccaccttttttcttctttttccagacagaggaatctccttatattaatggcaggtattatagtaaaattatcatttcccctgaagagaatgttacattaacttgcacagcagaaaaccaactggagagaacagtaaactccttgaatgtctctgctagtgagtattttatttctggcattacaaaagtaagaaaatttgaagttattcttcattagtttaaaatcttcaattccatcttcctgtactgcattatggtaagttttatttatttattttgcatttggtatcatcatcataaggttattttttcttttttcctgtccattcttgtactatccttgtcttgacagttaaatcatttcatgttttatgggtcagaggccttatcctgtacaggaatagttcccaaaagcaacagagaataaaaaataagtttctcttatttaattcatgttttatgttcagagtggagataattcaaagatcatcttaaaacatttttgtaacagttttaaatttggtaaatttgtaattccctttgatctattattttgccttctaattctttgtggtatttatcctacccttatgttgtactagaatgccacaagcttaaagtcatttagtaaactagcaagagtgattttagaattcatgaatctagtttacaaaactgttccttttgtcatatcatatttaaactatagccgaaaatcagataagtgaaactatctcagagaatgtggaaaaatctgtcgatgttgaaatcagggtaatacatacataccaacaacagcttcttcagaaaacaattgtcatttaatgtgaaattgtccataatcttcaattctatagttgttcctattgttttgtcaaccttaaatcaggactggcctagaatgaggctcagttctggacaggatgctaactgacctgccaaacttttattcttcattcagttggaaacctgtatatgacattagcaggctaggactacactagctgggaattagcaagagctaggagaaaataatcatcaaaaaataatggtccctcacagattatgactggaatataaaggcctaatggattgacaggataaaagaaccaaacaaatttaactctaagatagaagcattgacttctcagaatgcaattcagtgagtattgatttgtcccacctaggaagagaacctaccctttcttcctgaacacaagtttctctttttatgttaacccattgaatggtatgcttcagttttctaggccttgcagtgactttatcaacatttaatatagtcgttttcaaattcagtgagcacctcctgagatgccaatttagcatgtatgaggagaggtccgggaatctgcattttatcaaatgtcactggcagttccgatgcatgcccatgcactttgaagtttatttatagagtttaatattagataataattcaacacagtggtaattcttaaaatggacaaagagcatggcattatcagagtcatttggagagctttgcaaacatcatgtatgttgcttcttaatctcggaggtatccccagttttaacctctactcctactactttgagaacatctctagtggtaagtccttgacactggaggatgacaatgaattctcctatatcgggcaggaaagttgagaaaagttgataaacatcacactgtagacttcctaggtgccgacttgcttccctaaaaaaagaatgactattaaaaggtggtggatagtgggaaaatcaatatggatttcagattaattctataggtcatcagttatgaaattttctatggtagattaatatctttgcagttgtagctcctctccttaaaacaagattaatttctttgtaggcaaggtcatactttattaagtgtgattttttttttttttactgttagctatagaatagacattttatctttgagtattattacatcatactataatggtaaaggtgactttcatatatcaacaaattttgtttttaatttcatattaacatttttcatttcagtaagtattccagaacacgatgaggcagacgagataagtggtaggtactatgctgccgactcttcttccttgactatcagctcaagatttatgaagtgtcatggtataagtaattttcttagctgtccacaattttgacttgaattaaaataccaaagacaakatagtaagaatgctaaaattttaccctttaaaaatcacaagtttgcatgttaattactgtagtgagctttagtcatttttaatacaaagtaatagctagattgactttctgaaaatccttggcattgtctgtaattgcatggacttttcttctttgttgcagatgaaaacagagaaaaggtgaatgaccaggcaaaactaattgtgggaatcgttgttggtctcctccttgctgcccttgttgctggtgtcgtctactggctgtacatgaagaagtcaaagtgagttgtggaaaaaagatcttcatcgttcattgactttcactgggagaaaatacaatgtgctaattttgctcactccagtcgtgcatataatttatacaataaggaagatgtatccccaaatcaggttgattatatattttgtttcaactaattttgactacactgcctttgtcagggacatggcttgggatactgtttcacatgtgtccgtttatttgtctcaatcaatagcctgaattcaattatttgattttttcagtgcttgagtgaattttttaaagcgtatacttcctaaaggtcaacaaccatagactttttggttgaagttggagaagattcattaaaagtacctagtacatcttgtagggactgccaggtgtctttgcagtgacacatctggccagcaatgaaactgctgctgaggtaggaatatcttattgttattactcccatattctagttagttgactttgatccatataagagtctatatcagagaaaatcatgtcattatgtcaacttgagtttttaaaaatggattaaagtaccaacactacattaaaaatgctttagagatgttaaacattattagttatatgatattacagatagtatgaaccttacaaattatctaacagtggtttataaggaaaatccgatgaaccagcgaagattcttaacatacacacatgtcttatacttctcatcatctcactccyaaccctagattcagataccattgataggggtggggttccagcatctgcacttttaaaaagtttcactggtgattctgcggcatgctgctagtttcaaacatgggttttaaaccaccttatcttataaatgtgtaaattaagttttgcaatgggatgtctatagctagtggaactttggacttaattttatattatgtctgatatgtcccctttaaaaaaygtaagaaagttgacttaaaagagaatcaaaagaaaaatcagatttaaatcaggacccatgatctcaccttgtaaagatgccagttccaatgaagcaatattcaaatggagctgccatccaagggaggcagaagctctgaaattttgaagtcacatagcagcatgagcatgtattgagctcatgttctcacaacacatctataaagtacacaccattattattcatattttacattttaaaaatctgaggcagagaatggttaaatgacttgcctaaggttacatagtttgtagggcacagaattgttatttgatttaaggcagtgatgttttagaatctttgtgttgaaggagtagaccatactttctctcacttgctttattttgtgccacattaggcagaaacatttctcctgttgtgtgttgtcactgatgcacacgatgtccactctcacatgatggcacaactgctcctcatcttggcctttctctccttagtcttaagcagcccacaccaatacttggtatacgagtcaggattctccagagaatcaaaccagtagagggtgtgtgtgtgtgtgtacaaagaaagttttattataagaaattgactgacatgattacggaggctgagaagtaccaaaatctgcaggcaggaagctggagacacagtagagttaatgtgtagttccaggctatgtccaaaagcctgagaaccaggaaggtgtaagttccagtctgaaacccacatgggctaaaacccaggaagaactaatgtttcagtcccagactggaagcaagaaaaaatgtcccagttcaagtggtcaagtaagaagttccctcttactaagccttttttgttccattcatatcttcactgattaaatgaggcccacccacatagaggagggcaatctgctttacttagcctactgattcggttcaaatattaatctcacccagagataccctcacagacacagccagaataatgtttgaccaaatgtctgtgtaccacatgacccagtcaagttgacacataaaattaaccaccacaacttggtaacmaatatgttctttttctcaatgaacattttacctataaacacttcacatgggtttgtgtccatggcatctatagaaaattcggaagacctgtgctatgtaagtgaaaggaaaagcaaacagttgcccagaggcaacatccattttatagaagttctccttctgtgtgtacaggtttcctgatattcaaatcttatcctccctttataatccatgataatttactcacaaatccaacagcttgcgttctagggtattttcattttattatgacttctgaatactccacagtaattttacttcttaaaacaatgaaaataaaatttccctgtaccttgaaaattagctggaaaaaaaaactataattctttacattagggtcaaataaatgttaaattcttggagcacccccaacatccagtatctcatcagacaccatttgtccctctatgaataaaataaatttgtgtgtgtgtatgtgttctttcctttgtttcttcatgtggtaaccccaaattaaaatgatggataaatatatgctggacactgacttcatggtgtctttaggtgagagcctcaagcatttcctttaaaatatttcattaaattaagctcaacttctaccacctgatctgaacattcatctaaataactgttacctaatcgaaaagttcaccaactctgacagagttgatattattggtaatcaaagtaataaattgcaattctcatctgaagcatcaaggctttttattaagaatttgtggaatacttcagatttgctgagtgctttgcattcctggttagttattccttgcttgtgccttctgaaataagcaggcatttttggaatatgaattagtcttcttaacccttcaagctgctcatgcagagtaagttcagattcataataagatctttcaagttaagaatgtctaacgccatttttgtgatacagctagcaaagcagtgaaattttagcaacatttagctaagttctttgcattgataattttaaaagtcattggagaaagataagagaaacaatcttttatttctagtaaaatttaagagtrcatttgctaatatacctagtggctatttagccagcattcactccttattccactaatagaagctaaatatttttattataattttcaaaaatggaaaactggagcaagaaagacttggcaattgtgttcttttcccattgtgaaatgacatattcatttaggagtaaggactcatgacttttttgctgctttaatccatataacttcccaatggaagttttttgttaaaaaaaactgaaggtgctttgatgacgagaatagatgactctgatttttttccatgtatgtagggtattaactatcagagtcaggaaaaggcattaattagtccaccctatatctagttgtttaacaggtagaaaagcattgaagaactagagatatttcagtggttaccttctactatgttttccatttctctcatccctgtcctccaaacatggtttttagttctacaggaagttaaatgttactatttaagattcattcctatcttgcatatctcatagtacaagaactaatgaaaaattaaaagagctgaagttaaaggaaaaatgtaaaggcagagtgatgtagccacaaacttcttcacaagtatattaggaccataatttcaaggttggttgtatttaagagactctgacctccataattcctataactaaactggaagcaagtgttaaccaaacatctgtaatctcaaaatagtcattgtgtaaatcttggaaacttactgagagatttaccttttgcagctatggaactcaagactattttcatgaaaattagtgtgtawtatagaaataatccgaaaatctaaaagtcagaaataccctttgttagttctgccttatacgatgctttattattccagtactttcttggaagaaaacagagacaatcctaaattggctgaagggctaaagaggacttgcctacaacactgaaacctcaataaacaatgttatgttaacattgttaaaattaacaatgttaattaagcctttctagaatccttcctgttggtgtctcttaatatatggaacacgatcttgcaaaaaagttgattttaactgaattctatttcccagtcaatactcagctaaaagcaaatatatgttctcagaagagggactcctcactgaataaattgaaaagatagtgctggaggaccacttaaagcacattttaagtgacttttctcatttatcactgcatgagaacctaccgtttttctctttttttggttattttttactgaaatcctcaacaatttaatgaggtacatacaattaaccccattttgtagtatctaagtctcagtgggagtaacctgctcaagatatcataagtagtatcttgttccaaattccatatagtattttcaaatctattttgctgccttaccaggccttttttggaattaaaattttagctctgactttgattggctactggcatttaattggtactatggaggaaagggtatgatcttaagggcaggctgacacagcctctctctccacttgtatgagaagtcagactaattcaaacgttgacttctctcttttctctacccatgacctagcaggctgccagaaggaagaaaagaaaatacctcactatcttatcaaaccataaataatagaggggacttgatgggaaataaaacaatgtggaaatgccagagtctccatctagtcaatcacagggtcaccggccactcagagggcagcaccatccatggccctctcctcttctgctgcatgtgacctgaaagtttccacaaggaagaaagggcttgcatcaaaatataatgtgttcatatttcaaaatcccctctctatatattcgtttcatttttttaaaaaagatcacacttgttttaaatatattttccaaaggctaaggaacaaaaaagtcccattctctggcatgagccaggctgtatgtgtcccatcatctaccctaaagaaacattttgagctgtgatgctgagtgcatgcaggtggcttcctgttttcatgcacattcagtacagttgtgttttttctgatccctcagccttttacctaatggttgtcrtattcactattgacctagatggaaaagccattttctgttttcactgaggacacacgcattccctatttctttgtagagtcttagaaattctaaagacataaaattttcatgaggaatttctttgtagagtcttagaaattctaaggttataaaattgtaagttgtagtaataagaccaactatttattcttctctatttccttcttcaatcaagaaattgctcataactctcagtggggattagtgtcctgctgtcctcctctagtttttcattaaacttggcccaaggggagactccttctactgagctgtgaccaaagaaggggaaaaaataaccatactcctgggcatgaccctaactacctgcacaggtrtcaatggccggtttgctggaagtggtaactctacactgccaagatgccagtcctaaataccaacagctgtggtaccttctgtggtgtgaggcagggatgctcacggaaaacactcctctaactagcaagaaataaggatgcctcacacccgctctaagagaattttcaatttgttatacaaactgaaagcctgcttggaaaacctaaaatctcatgtactcctttatgtgtgaaatattttaagtgagtattgctttggttttctaaatataaaattctattatagtattttattggacttttccaaatgataccagccagattgtgatttactggctgcacctaccactgtcatccccttcacttgtcctgcctcctcyatcctctcactatgctattgttcagttaaaggcatacttacgggatacccccaaagcagtcccctaccccttttgagatttcaaaacaagtgtagaatattgggaaaatctcaccaaaaaaggtcttaaatcttctgaaaagttatttgaaagtaactttagccctttaaaygcactgcgcttaagggaaattacacagaatgaggagttgagacttagatttaaactctcttctgctgctcttggccatcaagctccctgactcaccttcaatttggtgagtccctgcatgtaacctgccagctgctttcacatacactatcacatttatcctcacaccagctctacgaggaaatcctgttgtttcccctatttatagatgaacaagcatgcttaagaggaggggttgtctaagatcttggagctcagaattaatacatgaggataaaaacccaggcttgcagaccccaaggccaagacccctctctgccttgcagcttagactagagggtcacctttagcacttcttcccacggtaacttactatgatcctgtaatttaaattttctctcatttaaggttattaaaaagaggcaccgatgaggaaaatttaaaataaataaccatcataatttatattttataaattgtaaaataaatgtatatatattatatatacatgtatacttatataatatatacatatattacatatatacwtgtatacatgtgtacgtataacatatatatacatatttatatatacatatacacatatataatatatacatatattatatatatacacatatatgtaatatatatgctattataacaaaataccataaacggggtggctttaaaaaaaaacaaaacaaatttattttccacagttctggagactgggaatttcaagatcaaggcaccagcagatctagtgtctggtaaggacccactttctagttcatagaggtgccttcttgctgtaacttcacatgatggcaggaggcaagagagctctccaaagtcccttttaggagggcactaatctcattygtaagggctccacctttacaatttaatcatgtgatggtcatatcatctatttcagggggacacaaacattcagtatatagcagtgactactactcccttcaagataaagagcattacatcacccccagaaagttcccttagacttcttttttgtccagccccatcatccctgtctccttaggaaaccactggctaattgttatgaccagagattgtttgcctaatcttgaacttcatacaaatagaattatagaaaaggtactcttttataatgggcttcttccccttaacatgtttttgagatttattcatgttgttacacctatgagtggcttctttttttatattgctgatagtgtttaatcattagaatatgccatatctttaaaatccattctcttcttggacatttggatactttccagtttgggctactgcaaatagtatggctaaaataaacatttttatacaagtggtttttgcagacatatgtttctattctcttgggtaaaaacctaggagtggaattgcttgatcttccagcagacatttgtttatgggaaataaacaaatagtcatcctgcttacaactcccaccagtcgcatatgagagttttagttccttcccatccttgcctaaatctggtgttattctgttgaattttagccattctaggaggtgtgaattaataactagttttggttttaacttatatttccttgagatctaataattttaagctccataaatgtataggctatcttatatcttcctttgtgaagcgactattcaaatcttgtgcctatgatttttattggtatttgtctttctgtaattgatttgtaagagttcttaacatattttgcattaaaatcctttgacatatatagatatatttgaacattttttcccagtctgtagcctggttttcctgttcttaatgctgtcttttgataagcagaaattattccttttgatgaagaacagctatcaatttttcctattatgttcgtgctttttgtgtctactatatgaaatctttgcttatcccaaaatggcaaaggtattttcctatgttatctcctagaaacttctaaactttgacattgaagggtatgatctatctaaaatttygtgtctagtgtgagataaaggtgggattttgtttggtttttgggtttgctgtatctatttatcaagccattccagcacttgttaaaaggacttcctttcagccgtaacacatttgtcaaaacttaatttaccataatagtatgagactttcaactgtgataatcttctggttgtttcagaggtcttatttctttgcatgttcatataaattttagcaacttgctaatttctgtgccacaaaaagttttgtggaattagcgttgcttttaatgtacaaatgaatttgggtagatttgacaacttactaatatttggtcttcaaatccatgatcatatatctcctcatttacttggctcttttcaatttttttctgagtaatatttcaaattttaaatgtagacatttgatatgtccttaaaagtttattcctgtatgtttatacattttgcagctattataaatacaattaattttgtaatgtttccaattgttcctagtagtatgtgaaagtgtgattaatttttcatgttgaaatgtatactgacatcttactaaattaccttgttagtagttatattcgttgttttgtggattcctatgtaaacaatgattgcatctgcaaatggagataattttactccttcccttctactctatatgccayatatttcttttgcttgcttttttggcactcataggcacctccaatacacggctgaatagaaatgttcagaatggacacctttgcrtgtttccagtcttagaggggaaattgctcaatagttaccattatgtaygatgttagctgtatgtccctacccagagttagtcaaactgcagagttaagggtataatcctccagattacctagtctgcccaagaattctgactccacctgcaaggagttagggtccgaccacaaagtaagagggaagagtacactcaagatcacccttacttctgacaccaaatgcaagttttggtgtttcccaaaagaatcctcaggtttgataattcactggaaagattcacagaacttactaaaatttttatattcctgattatatttattacaagaaaatgttacattaaaaatcagccaagggaaaaacaaatagggcagagtctaagaggattccaaatgcgaagtttccattgtcctcaggaatacattattctaccagcatcgatgtgtaacaaaagcatggagtatggccaacctgaaaggctcacccaaactttagtgtctacagttttcactaggcattatgacataggcatgattaattggttgaacttaacctccagcctgtctcctcctcaggtcaggctgatatcacatagctcaaagttccctccctaaactatgattggtctttctagtgtcattataccccaccctaagactgactagtgtagaaggccctgccctgagacatctcattagcataagctatcaggtgtaatttaagggagcagcatagataagaaaacctgtgtaactcataaaattccaactgtttagatgttgcctcccagaaactgaaaacaaaggtcagatatctctttggatgaagcaaattctttactacaaagtatcctttatcaggttgaataacttttttactattcctagattaccagtagtttttatcacaaattgttggattttctcaaatgttcttctatatctattaaaataatcatattgtttactctgttaatatagtaaattacattcattgattgttgaatggtaagccagtcttgcattcttgaaatacatcttagtctattatgatgtatcataatttttatatattgatggatactatttactgacattttattaacaattcttttgtctatgttcatgaggaatattggtctgtaattttgttttcttataacattcccatcaagttttggtactagaataatgtggatcttataaaatggatcaataaaagggccccatcctcttctttttccaagtttgttaattcgttaaatatttgatagaattcaataatgaaactaactggaccttgagttttctttatgagaacttgcttcaaaacaaaatgtaaatttttaaattaattaattcattttttttctgtttaagacagagtttcactcttgttgcccaggctggagcgcaatgtcacgatctcagctcactgcaacctccgcctcccaggttcaaatgattttcctgyctcagcctcctgagtagctgggattacaggcatgcgccaccacgcctggctaatttttgtatttttagtagagacggggtttctccatgttggtcaggcttgtctcaaacttccaacctcaggtgatccgccctccttggcctcctaaagtgctgggattacaggcatgagtcacagcacccagccaaatttcaatttatagatacagggttgattctttttgaataaattttggcaggttgctcaataatttatccatttcatttaaattattgacatttttgaaaaaaaaaaaaaagccggtagaattttttatcccttttatgcctatgggttctatagtgataacccttttttgttatctgatattgctaatttattttttcttttatctttcttagtctttatagggtgttatcaattttcaaaatgacctcaaataactttttgctttttttatctctattgcttattttttatgattttgctcttatcattactacttttttctttacatttccactttttctcctttctctgatttcttgaaataaaaattttgattcttagtattagactttcttcttttataagacaagcattgaaattataaattcctctcagcactgttacctgtgttccacaaatatcggtatgttgtgttttcttattcattcagtgaatgtttccctgtggtttcttccttgaagtcaagtgactagacctgtatgaaattccaagcatttctttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggactacaggcgtgagccaccgcgcccggcccatttcttatttaattcttttttgtcaacacaacctactacataatcttttagtctttgaagtacattgagatttattttttggcctagcatgcagtttttccttgtgaatactccacggacatttgaaaaaaaaaaacttgttgggggcttatgggtgtagtgttgtataattgtcatttaggattaggttarggtgaatcatagtttgtttaaatattcttacccttacttacttcttttaaattatacaaaatcacttcacatgtaatgtaagaaggtaacaagcatacacttctatttccctttcaggtattttgtgccattgttgttatttatcttctaagtactaagcctcacaacacactgtcattattttatgctctgcagtctattatctgttttaaaaattaaaaattatgagaaaactttcttttgtatctacttatttactccttccagcactcttcttatttttagtggatctgaacctttgtctatcactttcattctgaaaaacctcctttgacattactgggagtgcatgtctaccgccagtaaattctgagttttcatttttatgataatgttcttatttcatttttaattttgtttgctaatttcatgggtacagatttctaggttgatacttcttagaatattgagtaccttaaagatgtgccattgctttctggcttgtattgtttttaatgaggagtagttggactttggccaggtgtggtaatgcaaacctgtagtcctagctacacaaggagatcagccaggtgggtggctcacacttgtaatcccaccacttcgggaggccgaggcaggcagattgcttgatgccaggagtttgaaatcagcctggccaacgtggcaaaaccctgtccctactaaaaatacaaaaattagccaggcatagtgccacacgcttgtgatcccagctatgcaggaggctgagaacctgggagacagaggttgcagtgagccaagattacaccactgcactccagcccgggcaacagagcaagactctgtctggaaagaaaaaaaaacagaggctamggtgggatgatcgcttgagtccaggagtccaaggctgcaatgagctataattgtaccactgaactccagcctgggcaacagagcaagaccccatctctggagaaaaaagaagtaattggatattatttttcactgcttttgaaaatttggaaaaaatttcagcaatttttttacatatatgtttaccctcctttcttcataagactcctggtatacatatattagactgcttgaaattgtcccacagatcctgtctcaatttttattgcctttactgttttgaaaagattcatgttgcataatttctatgtctataacttaattgtcactgattttatttcagttgcaatatctgatcttccagtaaccccatacatgaaattatcatttctgatctgtgtttctcagtcctaaatattcaactttattttcagtcttctctttctattattattatactaatgttttcctctaaattcttataaacttctgtaattcctattttacaatccttgcctactaatttaattatttgtagggttttattaattcattttttctcccaattataggtcacattgctctatttctttgcatgtttagtaatttttgtttggatgttggaaatttggatgttatattgttttgaattttgtttgacaggtagccaagttacttatggatcagcttaactttttttggagcttggttttaaactagattatgatggatgtatccaaattagtacttgaagaaggaatcaaaggaatgcttatgtaaatttctcatgcgcttttctttgcataactctacctctttcctgcaattttcatcatctccttccagccaagtatgatttctgccttctcaactcagtgaaaactcttttctgcttgggtccttatttttggcaccaccagaaaatacttccaggcacaaagcctggattgtcatcaagtgcaactagtggcttttcccttagaaatcacacagatcagagtactttgctacctgttgtccaatgacagaaaatacttgttcttttattctttttcttaaaaatacatgtttatggcaagagagctagcccagtgaagcaactggaacatatgtggattttggtattcaagagaggtcctggaaccagtccactgctgataccaagggacaactgtactatttacttcatcaggatcatacatattaaatgttggtacaattgtcttaccaattattgagaaagtgatatcgaatcattcaataaagattgtacatttatttatttctcccttcagttctgtcagtttttactttatacttttattaggtrcatatacttacaattgttataacttccttatatatgaaacctttgtaattacaaaatatctctcattatctctgataattatcaattatatgtaagaccacctccctatctgttttctaggaatcttctgtccttccatcctgccttcttttgaattacttaattaagttttagtattacattttaatacctctactggccttttaactatacctctttgtgttcgtttactgtggttgctataaggattacaataagaactcaaaacartctactcatgttaaaaatctaagatttttgaagcataatcccatttaacttcctctatctttgttgctattattgtcacatctgttttatctgcatatattataaagatcaactgtgttttacatatatatgcatataaagcatatatattaaactgttagttgtcttttaaaatattttacatatctacaatctgtatttttttattctttcttacgtatctgaattcccatctsgtgttacttcccttcgaagaacttcctttaatgcttcctttaggaaaggtctgctggtgatacttttttctactttcttttcatttaatttaatatgtctttcttttgcctttaagtgaaggatcttttcactgatataaaattttgggtttaaaacttttcctttcagcattttaaagatgtttaattatctctggtgtgcactttttttctgatgagacatcacctgttatttatgttaytgttctcctgaacaaattttctgtggcactttcaaacatttctttttatatttgcttttggttagtatgtctatgattaacttgagtgtgtttttccttttgcatttcctccttccggacttctgagcattttggatcttcaagttaatgggcttcatcaaacctgggaaattttctcattgtttctttaaatatagttttgcctcattctctttctcttctgtttgacttcaaatayatgtatgtcagcatatgttagcctgctcactatcatctcacaggccactgaagatctgctcactttttttttttccactgccctggactccaccatctcctcacttttttactgttttctttctctctgttttccagaatctgtgacttacaattttgttcctaggttcactaatgctttcttgtgccacctctaatctgatgttaagagcatttagtgaattgttcaatatcaatattctagttttcagtcatagaattatttttgttcacattttttgctgctgatatttccatctgctctctcattgttaccaaattttcctttaagccattaagtgagtattatataattgacttaaaattcttgcctgctgattccaaaatctgtaaatctgcatcacctaaggacattccctggactttgtgttacatttttctattcagtgtatgtattgtaacttttttactatataatggattttgtgggtgatatgttttagattataatttctgttatatttttctaaaggatatgagttgcttttcctagcagacaattagattactggctaattactctactgtcaccttgcgcttgtgatggttaattttacggtttgtattccatgtctgtcttaggatgaatgtctagttcttttattttattttttttattattttattttatttatttatttttttttttgagatggagtcttgctctgtcacctaggctggagtgcaatggtacaatatctcggctcactgcaacctctgcctcctgggttcaagcgattctcctgcttcagcctcccaagtagctgggattacaggcacacgctaccatgcccagctaatttttgtatttttagtagggacaaaaattttagacaaaaaacttttagtaggggttttaccatgttggccaggctggtctcgaactcctgacctcaagtgatccacccacctttgcctcccaaagtgttgggattacaggtgtgagccactgagcccagcctgtgtctagttctgacacatagtctttcttgttttttctggggtttcagtaccaagactgatgtgtttgctaagcacttctggcttggtgaagttcaactccaaactgtgtgggtagtacctaaaaatctatcaggcttctaagccttctggtattgctttccactaagctctttgaaatttctcccacatatgctattcagggggtcatccaaggagcttatcatagtgtatacgcaaatttggaattcttgccaccctgtggctgtctcctttctaagatttttcttccttgatttccagcttttggtctacttagaccatgcctcccaagctgagaagtgccctcagaggaaaagccatgtaaaattttctttcaatttctactttatttttgtcactctcaaatacattcacatacttcattctgtacttttctgagggtttataattgttataaatataagagttaacaaagtacacttggtgttttgtttttttttcagtgttactcaaaacagaactccttgtagtccatgctttattttaaggttgtgaaatcatttgcacactcaatgagaatatggctttattcttaccatacaggtcaaggcagattaaaaaacttaaaattgcaatttatattatagtagtcactgtcctgatgtattacattgttgttttttttttaattttattttttaggatttaccaactgaatgttgacttctttatgtatcactctctagttgctccaaacaagttatgattcttactttagatgaaaggagtggcagttaatgaagtgagtttaaaagaaaacagacaaaaagagaaagcaaaaggagaagtagaaagaaaaagaaaggaggaatggaatggagaaaaaaattagaggactgagagaagacaaggggaagaaaaaagagaggagagaagagattttggggattatgtggcttttttaaattgccacaatatcttactgatttatagaaattatagttattaggatatatagttagtagctattagaataatcaaagacctgtttatgaatataattttgtgcagaactatctggaaaggttggattaagaatcactcaagttctgtcatttcaatgtagtattttgtcaacttgcttataaaaaaaagcagctgggtatgtatggacttcatattggtgaacactaatatattaaggaacagtggaaggaaatagacataaaggatcatgtcagttcaacttagtagaataatgatcttttggatgcctaccatgttctagtcactgtattatgtgctatggataaaatataaataaaacatggctattattctcaaagagtttgtggtcaagtcaaggaaactaaagagatgtctcacatctcagtgtttccttggggcagatggatggagaaatgagctaagagcttgaagggaaaagctggatttcwttgcattttttgagctaaagaaagggatactttctaggatgtcaattagaagcctgaaagaaccatgccttaggaataggagcaagccaaaggtagaccaaattttactaaaattgcagtggggctccaacaaargtcaataacctgatagaattgtgtaatcagccccttagcctaacaaaggaaagggggagccatagctgatagaaaataacattctgtagggtctctacagttcttttgttcatagggtcagcaaaatttaaaaggacaagatattcaaagagtcaagaaaatacaatcaataatctagagaaaaagtaggtaagataagcaaacaataactgaattatttgaatattgtagttaatagataaggcaatgaaaataactataaatatataagaaaatgtgtaagaaaagatactcaaaagagataaaaggagtagagaattcaaatgcaataattgaaaagagaaaaagaattatatctttcagttccaaaatgtcaatttgattttaaaggatcaaattgacatttgggaactgaaagacataatattaaacactgtgttttcagtggatgaatttaacacagatgggccacagcagagcacaggaaaaggaaattggaatacacatcgatagaagacacacagactgaagcacagagaggaaaaagaacagccaagaccaacaagagcataagaaacatgtggacacacacatgtctaagctatgtatagaattgaaattccagaagaatgaaagagcaagaatagcaatcaccggtaaaataaataaatacattgtggtttattcaccctatgacatcctatagaccaatgagaatgaacaatctataatcatatgcaccattatacatgaatgtcacaaacttaaggttgagtttaaataaaaggcaaacacaaatgaataaatctgagatgattccatttatgtacaaattacaatagcaggtaaaactattatgtgagaattcaggttgtagtagcctttgggcaggaagtagactgcaaggtcatataatggtctgcaattgtctcttattctggatgctgggaggaaaggaaggaagggagggagggaaggtggaaggggtgcactcttggacatacagctaccatttgttctgctttctcctagttagccacaaacccttaattgtgtaattaagaaaatctgatttaatgtcttaaagaataagagcctaggcatgggtaatcaaagtagccgctaaggcattggttttcaaactgtggcaggcagtggaatcacctgaggagttgtttagcagagatcgcaggtcccatccccacagtttctgtttctgtttctgtagttctggtatagggcccgagaatttgcatttcttgcaagttcacaggggatgctgatactgctggtctggggaccataatttgasaaccagccacgttaaagttgctatagcttctgttgtcgatgttctatcataaacttggtctcaataatctggttgttgttgtattcagtaaaacagaatattcataaagatagacatagggtgttagctcaactgggatacatgatagggaacaccagaagggaacgcgccttcatgaaatgtccttaagaaaatttttttggagaaaattcgcttagaacaaaaatttacactatcaaatgagttacttcccagaaagtggagagaaaaataacctagctaaaaacatgatgcacaaagtgttgtatagtctgttttcaaaataattgatttttttttctcttagcatacatttactggaaccccatcaccaagctaatttcagtasaatgtgctccattatcagtcaaggctcacagatatggaaatttttgcctagcggtttgctgtaaaacatttgcttttcaaagacacattaattcaaatcttaaaattaaatataaaagttgaacatgtatgtgtcaatatgatgaagtttatttaattctcttacaggactgcatcaaaacatgtaaacaaggacctcggtaatatggaagaaaacaaaaagttagaagaaaacaatcacaaaactgaagcctaagagagaaactgtcctagttgtccaggtgagtagtctgtacgaggttcatagaaataattccctagcaagtaggaaacatccttaaagatgaagtcctttatgttaagatgctccataattacagctttcaaaacaggaagagaggggttttttttctttttattatgctttaagttctcagatacatgtgcagaacgtgaaggtatgttacgctggtataaacgtgccatggtagtttgcacgcatcaacccatcatctacattaggtatttctcctaatgcgtccctcccctagccccccaccccctgacaggccccattgtgtggtggtcccttccctatgtccatgtgttctcactgctcaactcccacttatgagtgaaaacatgcaatgttgagttttctgttcttgcgttagtttgctgagaatgatggtttccagcttcatccatgtccttacaaaggacatgaactcgtccttttttatggctgaatagtattccatggtgtatgtgtgccacattttcttaatccagtcgatcactgatgggcctttgggttggttccaagtctttgctattgtgaacagtgctgcaataaacatacatgtggatgtgtgtttatagtagaatgatttataattctttggctatatacgcagtaatgggattgctgggtcaaatggtatttccggttctatatccttcaggaatcaccacactgccttccacaatggttgaactaatttacactcccaccaacagtgtaaaagcgttcctatttttccacattctctcaaaacaggaagagagtttttcgaaaggaaactttcgtgactcagaaagtgttttcggaagaatggaaacttaccagtttcccccactccctcctcaaaataatcattatcttctgaataataaaaaccaactatgagatgttaacattcaaytatcattttatattttaatgcaaaaactttaagtgcaaagaagctttattttttgaattggtgtttgggttcagtaagaacagattctaataccttagatttgttttaaataaatgattatgaaaataattttaaaatatgaaaattttaggccaggtataggcaatggctcacgcctgtaatcccagcactttgggaggctgaggcgggtggatcactggagactagaagctccagaccagcctggccaatgtggtgaaaccctgcgtctctactaaaaatacaaaaattagccagtcctggtggcaagcaccgataatcccagctactccagtggctgaggcaggggaatcacttgaacccaagaggtgggggttgcagtgagccaagatggtgccactgcactccaatctgggtgacagaatgagattctgtctcaaaatataaaaataaaaaaataaaaaactttaatctagatatttaataaaagcgtgagtgtatktatacagccaatatcccaaatcattttaatgaaaagcataacaaacttgtgcacgtgtgtatacatatacgcatatgcttttataggtagtatatgtatgtgtatgtgtatatatgtatccatgtatctatatgcacatatgtagaggcatatgactgttatatttaacatataaaatagctgtgtgtgatttttaagacaatctcaaaagaggtatgtttccatggcattgccacctgcaatttgaggtttttctttttatttgtgttcccttaaaccaagcaaatagaagagccatttggactattaatgtgtcctttagaataactgttactatagcttaccgatatgatatgacaagccccaaccgccacagtaaacctcgggttcattataaataaaccacaagtcacaatttgagtgggtcatccaagttaatcccatagtaaggatggagcgtgagaaaatactgaatttaaaaggatgcacacaggggagaacaatagaataattgaaacaagacttggtttttaaaatctgaaagccaggattttaaactgatggggtgaaaggaatcagaactggattgcttctctatctcacctttcattggaggtcaagtatgcagcattcccacatgactttttttgtttgttttttccacttctctagggttcttttccccagtcctttgtaaacatagattttaactactgttttcttcaaaatcgtataacttctcaatgaaaaactgtacttgaagacaaatcccacgaaatagtgtgatttgaagaaatgagtgtacttttaacctaaagagaaatgcaatgaaatattttcttgaaaaaaaacttgtaatattagtattaattttacaaaaaaagaaaactctgaataattccaaaaactatttgtagaatggatgaagcaatgcctgagattatagatgggcttggggacaatggagttttataaaaggccctcctgtaaagtaatttactaaattacttttagtacaaagtatctgttgatgttaaaaaattattgctttggaagcttatctaaattatttttttttcatttcagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaataygttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccrggaaaaaaaaagacaacattattaccatcgattcagtgcctggataaagaggaaagcttacttgtttaatggcagccacatgcacgaagrtgctaagaagaaaaagaattccaaatcctcaacttttgaggtttcggctctccaatttaactctttggcaacaggaaacaggttttgcaagttcaaggttcactccctatatgtgattataggaattgtwtgtggaaatggattaacatacccgtctatgcctaaaagataataaaactgaaatatgtcttcacaggtctcccacagctgtctgactcttgtctaaagtagaatgttcatgtgtggaaagtgattgtctttatcaaatagtggaaaactcactgtgactctccatctttccagagaaggagtgcagaaaaataaaattcaccatgccttcctactaggtcaggtgggctaccttagctagtccctagatttcaccagtgatagattctataatgcatctgtcttcaaagataggatcatacttactcttgggtgtcccatgtaactctcctaggaccttaattacgagaacattttcatatttgttcacttctgccaataacattctattcagattgtcatttggaattacccaggcctgaactttcagaaaatatattccctccaaaataaggtaaagccagctgtgtacataagagaaggaaattaacatttattgagcccatactatgtgctagggtcattcatacattaacgcttaacagttaacagttgtaaatagtactaaatatccccctcatttaacagctgaaaacctgaggtttagagaaacttcataattcccaaatgcccttagcttcaaagtagataagttgggtatcaaactagatctgaatccttgccccaacctacgtacttccctaagttcctctaaagaatgctccttttcataatatgtaaaattggaaaacgttaattgacacatggacgggttataccattgataaaaggattattctgagatatttaaatcattcagaagggcaaaattgcataatttttctacagtacttaaacatattagacatgttattagaatgtataatatattccacatcatatttttaaacttcacatatgttattacatactaagtgcctattatgagacagtactgtattggtgcgtgttttaaataatgtttcattgaatttctctgataggagaggtgtgatgcctattttaaagatgaagactcaatgcatataactttgtcacaattccagatacagagtggttgagccaggacccatgctcaagttgctgaagttcaggctcgattcattatattgtttatcatcccattataagaatatacatccgtctacacttggagagactaacaaaaagatatattagcattaaataacctatttgtttttctagtaactagtgccattgatattcaaggtaatatgattaaaataagacattaaaactgctttgaaaataataaatgacggtgtaaatgttagctgcattttaatcttatatctaaggaattaaatggaactaactactatttgaaaagtcagtgcagtatatttggctgtataaacattatactttcacagtgggaaatatttcagttaaacactgaatatatatttcttatgtaggcttcttcactaaaaccttcttaaaaatactctgtatttttacatgaagccagaaaactggggctcattttttttcttagcactctatcatcacctgttcatcctcattctaatcaaatttctttttatcctaattctgcttctcatattttttcctgataaatgattttcacatgcacaaatattcactggaaaattaatacctaggcacatgactccaaaagcagatctcattctcaagttatttgtcttatccatttttattgtctgtctctgggaaaggttttaccctgtaatgatcaagcctctaaatgagagaaaagatcttcaattgggtatatagatgcatgcgcatgcacacaaatacacagaggcagacaacacacacacacacacacacacacacacacagaggcacacacactatgggctattttatcccttttttttttttgaagagagaacacaggatttgcttatcagaaaagaaatcgaaggactacaaaatatttgtcaaaaatagaaagcagctaagaggtggaagtattcatgatgctttgatgggaggcattcataagtcaaaggtccaatagtgtattagacccaatagttgcaacaaaatttgtttgagtaaacctaatcatataatctctatgctaccaagaaacaagtaagagccttaatatcacagaggctcaaaataatgtttttacattctttgaaagaccacatattatcagagagcaaaagctatagtcgccagaaagtacagtatttgattaaaaaaagaaaaatctggggctaggcacagtggctcatgcctgtatctccaacactttgggaggccaaggtgggaggactgcttgagcccagcctgggcgacatggtgaaacccaatctctccatctctacaaaagacacaaacaattagccagatgttgtggcacaagcctgtagttccagctacttgggaggctgaagtgggtagatcacttgaacccagaaagtggacgctgcagtgatctctccactgtactccagcttaggcaactgagcaagaccctgtctcagggggggaaaaaagtacttttggatgctgtcagcaactcaatttggactattttggagttaataatcaaaataaaattttaagatctcccaaaaatatctttcttttgattctactttctcaggtaggccataataattttagcttcaattagcagtttaaattcacggcttgattcacataacatctgagaggctcacttgcacagagatagcagttttggacagctctgtgtaattctttgaattctcatcagtaaggaagccacattttttagttaaataagatggggttactgcttgaaaactgattcacaaccctccctggaatgacttattaaggaaatggaatatttctgttacaaaaaggtttatatctaagcattagagtcattccttgtatgctaaaccttttctaaaaaccaagtttgctctgaaattttgggcttctacattgttggtaatcactaaatttctttttcttagcttgattataattgtctacgaatatccttaaaatagtctttaattgaaagcaaatagtcataacctattgttgaatctgattccaagaagaaggactatttgaaatatttgtaggtttatttaccacaaatattttaagttactacaaaaagtagtaatctttttataacatttcttaatttagagagctttttgtttaaatctaatagcagcatacaagctgtgtaaaagatgatgggtttttggtcacaatggaaacaccaccacataaacaacagatccatctgcccccatgttcctaactgatgaatctgtttacagagaaatgtcattaaaagattgcctgtagtggctttgttacttttctgttaatttgagtttaacctttcttgaatgtaataaaataaactcattaaaatatcaaatatgtacttcacagttatcaccacagcacttaactatatgttttgttgtcctgataacaatagtaatgtatgtaatcagtgttcatttcaaacgtttacattgattgaggaatatagttgatttcatgaagtttctatagcgttgatggagtgaactttacattggtctcttcagcatcgttgcccagtagtacctggcattgcaccaaagaaaacccagtgcaggggcggggcagcttttgttggttcagcttcatcattcctcactcttattattggatatcgcatatgaatgcttgtataagttgtgaatgggaaatctgcttctcagtttctcctttaaaagatttttccaagcttttgatccaatggggaaatcctgtggttgggagcaaaatcaagtgggctttaccaaaataatttgcattccattttaaaaattaaagtccagaatggagcagctgaggtttggaaacttggatgagtatggggagcggttcagttatgatttgggtctccaaatcagcttgaatttccagatttaaaccacatgtatttataatagcaattaactgagcatttgctgaaagatgcctttgtgtaatgacgcatgtgactaactatcagcaccaatcaaaacagttggttttatccctggttcacattttcttcttagagaagaaaattttcttctctccgtttccctcccagggcttctacaaaagtgggaagtttgtgttcagttttaaggtgagtcccatgcgggcagggatggctctctggactttggaggcagcagcttcttagaggaagctaccacagtgtaagtcttttccctccatccctgtttgtgcaggtaccagaagatgcctccttaagttaaaagcttttgcaaaaagcatcctgttgtttctttgatgatccatttgttgcattagttgccctaattctttacccttacttatatccatatcctttgccatgtgactttgcagctcctcccacaaaagtgccagagcatcatttcccatctcttgatcctacattgggccatatgatttgctttggccaagaaaatcatatggaagtgacagtccactagttctgagcctcagcctgaaactgcctactgtgtttcctcttgcccttttgtatttgtcactgccatgagaaaaacagaagcaaataaccctgctaatgccaagaggaggttgagagacacagagagcagatctgtaccacataaggtgcctcattcaaggccagcctggagcagagctcctagccaatccacaggtacatgagcaagtccagccaatgtcactaaagcccaatctgtaccagctgtctctcagacaatccacagacatgtgggccacaataataaataattgtcgtttttaagccattgcacttttacattgttatcatgcaacaataactaactagtacaccttttcacaggcagctgagttcctgattgacttattggttatggtaatatcaagaacagtcattccataaaaattcagagacattttattaaaactccactgataagtcttttgtgctatcaaaatgcttccttcctccttgagctttctgggaccaacattcacgacccaaaaccctcaacgtatagaaatatgctattgaatatactttagtatcaataaataaaaatctattgtagtaatgccaggtagcaatttagagatcattgttaagtatacaaatcacacacaagtctcttgacagaccgggcatgtgatgtgttttgcctgggctgggccacatttgcccgttttcattgttccaaaagttcatcgttcaagataggttcgtacaattgctctttctttgtgcccacataattacatgccartacctttcctcaaattagaaattatattcaggcaagggattctgctgacaccacattcctcaccaaatgtcagagtctcttaaaaaatactgtaagctcaaaaggcctaattaggttttcagtaattcatgtcattggtcattaggacaatcatacaaatcagcaagcactcaggtgtccagacactaaatggagacacgaatctaaaagatcaccggcaacagccctaaaagaaatcaaaaaagttttctcactgctttcattaaccttttccttacgttttcacatttcaggcacttattctctagacctataaaactgctcagcaacaaggttcggggaaaggaggtggaaataatatggattgtctatttaaatgacatgtacttgggaagtagttattaaacatacttacagatgcatacatcctcacccattttgctgcaagctttcggattctgactgtccaccatatcctggatgaagcaacagtaacaacgatgagaggggagacaggcgtactttgttcttatgttcccaaagggcacagggcattcttgagggacagatgaacttaatgatttaatagaaataccatgacctttagaaataagcagactctgattggacttctaaatgaatactatggatctacaacttattagaagtgaggccttgagcataatacctaaacccctgagcctcaattacatgatctgtaggatggcagcaatattaattg
